US008298799B2

(12) United States Patent
Bornscheuer et al.

(10) Patent No.: US 8,298,799 B2
(45) Date of Patent: Oct. 30, 2012

(54) HYDROLASES, NUCLEIC ACIDS ENCODING THEM AND METHODS FOR MAKING AND USING THEM

(75) Inventors: Uwe T. Bornscheuer, Grelfswald (DE); David Weiner, Del Mar, CA (US); Tim Hitchman, Encinitas, CA (US); Jonathan Lyon, San Diego, CA (US); Sirirung Wongsakul, Chiangmai (TH)

(73) Assignee: DSM IP Assets B. V., Heerlen (NL)

( * ) Notice: Subject to any disclaimer, the term of this patent is extended or adjusted under 35 U.S.C. 154(b) by 293 days.

(21) Appl. No.: 10/547,956

(22) PCT Filed: Mar. 8, 2004

(86) PCT No.: PCT/US2004/007095
§ 371 (c)(1),
(2), (4) Date: Oct. 5, 2006

(87) PCT Pub. No.: WO2005/032496
PCT Pub. Date: Apr. 14, 2005

(65) Prior Publication Data
US 2007/0202566 A1    Aug. 30, 2007

Related U.S. Application Data

(60) Provisional application No. 60/453,450, filed on Mar. 7, 2003, provisional application No. 60/458,123, filed on Mar. 24, 2003, provisional application No. 60/513,332, filed on Oct. 21, 2003.

(51) Int. Cl.
*C12N 9/14* (2006.01)
(52) U.S. Cl. .......................................... 435/195; 435/196
(58) Field of Classification Search .................... 435/195
See application file for complete search history.

(56) References Cited

U.S. PATENT DOCUMENTS

| | | | |
|---|---|---|---|
| 4,707,364 | A | 11/1987 | Barach |
| 4,719,178 | A | 1/1988 | Macrae et al. |
| 4,752,483 | A | 6/1988 | Hagberg |
| 4,861,716 | A | 8/1989 | Macrae et al. |
| 4,873,109 | A | 10/1989 | Tanaka et al. |
| 5,061,498 | A | 10/1991 | Matsuzaki et al. |
| 5,304,477 | A | 4/1994 | Nagoh et al. |
| 5,395,629 | A | 3/1995 | Bertoli et al. |
| 5,470,741 | A | 11/1995 | Oester et al. |
| 5,508,048 | A | 4/1996 | Padley |
| 5,654,181 | A | 8/1997 | Oester et al. |
| 6,022,577 | A | 2/2000 | Chrysam et al. |
| 6,127,137 | A | 10/2000 | Hasida |
| 6,660,491 | B2 | 12/2003 | Norinobu et al. |
| 2007/0202566 | A1 | 8/2007 | Bornscheuer |

FOREIGN PATENT DOCUMENTS

| | | |
|---|---|---|
| EP | 0 427 309 | 12/1994 |
| EP | 0 093 602 | 3/1995 |
| EP | 0268456 | 5/1998 |
| EP | 0 882 797 | 12/1998 |
| EP | 0 196 210 | 1/1999 |
| WO | WO-83/03844 | 11/1983 |
| WO | WO 92/13130 | 8/1992 |
| WO | WO 93/24619 | 12/1993 |
| WO | WO 96/40844 | 12/1996 |
| WO | WO-97/01629 | 1/1997 |
| WO | WO-99/14338 | 3/1999 |
| WO | WO-99/66805 | 12/1999 |
| WO | WO-01/75076 | 10/2001 |
| WO | WO-02/06505 | 1/2002 |
| WO | WO 02/20735 | 3/2002 |
| WO | WO-02/26998 | 4/2002 |
| WO | WO 02/29022 | 4/2002 |
| WO | WO 02/057411 | 7/2002 |
| WO | WO-02/081719 | 10/2002 |
| WO | WO-02/094949 | 11/2002 |
| WO | WO 03/089620 | 10/2003 |
| WO | WO 2005/032496 | 4/2005 |
| WO | WO 2005/086900 | 9/2005 |
| WO | 2006009676 A2 | 1/2006 |
| WO | WO 2006/096834 | 9/2006 |

OTHER PUBLICATIONS

Ahn et al., Chem. Commun. (2004) 364-365.
Arisawa et al., Appl. Environ. Microbiol. (2002) 68(6):2716-2725.
Briand, Eur. J. Biochem. (1995) 228:169-175.
Gupta, Appl. Microbiol. Biotechnol. (2002) 59:15-32.
Haring et al., J. Org. Chem. (1999) 64:832-835.
Hoondal, Applied Microbiology and Biotechnology (2002) 59:409-418. Jimenez, Biotechnol. Prog. (2002) 18:635-640.
Kadowaki et al., J. Biol. Chem. (2000) 275:25577-25584.
Kurvinen, Lipids (2001) 36:1377-1382.
Loeffler et al., Science (2001) 294:2170-2172.
Rogalski, Chirality (1993) 5:24-30.

(Continued)

*Primary Examiner* — Tekchand Saidha
(74) *Attorney, Agent, or Firm* — Baker Donelson Bearmen Caldwell & Berkowitz, PC

(57) ABSTRACT

The invention provides hydrolases, polynucleotides encoding them, and methods of making and using these polynucleotides and polypeptides. In one aspect, the invention is directed to polypeptides, e.g., enzymes, having a hydrolase activity, e.g., an esterase, acylase, lipase, phospholipase (e.g., phosphlipase A, B, C and D activity, patatin activity, lipid acyl hydrolase (LAH) activity) or protease activity, including thermostable and thermotolerant hydrolase activity, and polynucleotides encoding these enzyme, and making and using these polynucleotides and polypeptides. The hydrolase activities of the polypeptides and peptides of the invention include esterase activity, lipase activity (hydrolysis of lipids), acidolysis reactions (to replace an esterified fatty acid with a free fatty acid), transesterification reactions (exchange of fatty acids between triglycerides), ester synthesis, ester interchange reactions, phospholipase activity and protease activity (hydrolysis of peptide bonds). The polypeptides of the invention can be used in a variety of pharmaceutical, agricultural and industrial contexts, including the manufacture of cosmetics and nutraceuticals. In another aspect, the polypeptides of the invention are used to synthesize enantiomerically pure chiral products.

20 Claims, 138 Drawing Sheets

OTHER PUBLICATIONS

Sadek and Richards, J. of Applied Bacteriology (1957) 20:137-144.
Seo and Rhee, Biotechnology Letters (2004) 1-5.
Tyrrell et al., J. Neurosci. (2001) 21:9629-9637.
Wongsakul et al., Eur. J. Lipid Science Technol. (2003) 105:68-73.
Yamamura, Biochem. Biophys. Res. Com. (2002) 294:1138-1143.
EP05762779—Supplemental EP Search Report—Sep. 16, 2009.
Khamessan—Journal of Food Biochemistry (1994)—20-311-328.
BITAR—Journal of the American Oil Chemists' Society (2004)—81-927-932.
GENESEQ Accession No. AEH46911, Environmental isolate DNA encoding a hydrolase—Jul. 27, 2006.
GENESEQ Accession No. AEH46912, Environmental isolate hydrolase—Jul. 27, 2006.
NCBI Accession No. YP001643484—Phospholipase C—Sep. 24, 2004.
EP07853585—Supplementary EP Search Report—Dec. 3, 2009.
GENESEQ Accession No. AED28321—(2005) GRAMATIKOVA.
GENESEQ Accession No. AED28443 (2005)—GRAMATIKOVA.
GENESEQ Accession No. AEH47258 (2006)—BORNSCHEUER.
TAN—Biochemistry (1998)—37-4275-4279.
EP05727242—Supp. EP Search Report—Sep. 28, 2009.
HORSTMAN—Archives of Biochemistry and Biophysics (1999)—361-149-155.
AUIP—Sep. 23, 2009—Examiner's First Report—AU 2005221136.
TITBALL—Microbiological Reviews (1993)-57-347-366.
Dennis—Journal of Biological Chemistry (1994)-269-13057-13060.
Roberts—FASEB Journal (1996)-10-1159-1172.
Rebecchi—Physiological Reviews (2000)-4-1291-1335.
GENBANK Accession No. AY195600 (2003)—Pomerantsev.
GENBANK Accession No. Y16268 (1998)—Lovgren.
GENBANK Accession No. M24149 (1989)—Gilmore.
GENBANK Accession No. X64140 (1992)—Gavrilenko.
GENBANK Accession No. X64141 (1992)—Gavrilenko.
GENBANK Accession No. X12854 (1988)—Johansen.
EP06748332.1 Extended EP Search Report—Mar. 8, 2010.
JAEGER—Tibtech (1998)-16-396-403.
KLENK—Nature (1997)-390-364-370.
UNIPROT Accession No. 029131—(1998)—Klenk.
GUTIERREZ—Trends in Biotechnology (2001)-19-340-348.
Takamiya—Trends in Plant Science (2000)-5-426-431.
PCT/US2005/20866—ISR & WO—May 9, 2008.
PCT/US2005/020866—Int'l Preliminary Report on Patentability—Mar. 19, 2009.
PCT/US2005/032351—Int'l Search Report & Written Opinion—Jun. 3, 2008.
PCT/US2005/032351—Int'l Preliminary Report on Patentability—Mar. 5, 2009.
PCT/US2004/07095—Int'l Search Report & Written Opinion—Jul. 31, 2008.
BIRSCHBACH—Bulletin of the IDF (1992)-269-36-39.
HARBOE—Bulletin of the IDF (1994)-294-11-16.
KANFER—Lipids—(1975)-10-391-394.
KOTTING—Lipases and phospholipases in organic synthesis. In: P. Woolley and S.B. Petersen, Editors, Lipases, Their Structure, Biochemistry and Application, Cambridge University Press, Cambridge (1994), pp. 289-314.
ZWAAL—Phospholipase C from *Bicillus cereus*—Methods in Enzymology (1974)-32-154-161.
GENBANK Accession No. AAD35127 (1999) Thermotoga maritima MSB8—Nelson.
JPO—Mar. 23, 2010—Office Action—2006-509241.
Columbian Patent Office—Apr. 19, 2010—Office Action—05101225 (translation of office action and comments provided by foreign associate in letter dated Mar. 18, 2010).
Examiner's First Report for Australian Patent Application No. 2004277368, mailed on Mar. 18, 2009, 2 pages.
Branden—Introduction to Protein Structure, Garland Publishing Inc., New York, p. 247 (1999).
Chagaev—"Role of Fibre Collapse in Mechanical Pulping" (Abstract)—International Mechanical Pulping Conference Proceedings (1999).
CISNEROS—"Fiber Surface Characteristics of Hardwood Refiner Pulps" (Abstract)—Pulping Conference Proceedings (1992).
EPO—06748332.1—94(3) Communication—(Jul. 4, 2011).
Haller—"Cartapip(R) Treatment of Wood Chips to Reduce Pitch and Improve Processing" (Abstract)—Pulping Conference Proceedings (1992).
McFeeters—Plant Physiology (1971) 47-609-618.
Nazhad—"Influence of Formation on Tensile Strength of Paper Made From Mechanical Pulps" (Abstract)—Papermakers Conference Proceedings (2000).
AUIP—Oct. 11, 2010—First Examination Report—2005264938.
COUTINHO—Food Research International (2009) 42-536-550.
EPO—Feb. 25, 2010—Article 94(3) Communication—EP05762779.6.
SUZUKI—Journal of the American Chemists' Society (1993) 70-837-841.
PCT/USIB2010/052581—ISR—Dec. 27, 2010.
PERE—"Use of Purified Enzymes in Mechanical Pulping" (Abstract)—Pulping Conference Proceedings (1996).
Schelbert—Plant Cell (2009) 21-767-785.
Seffernick—J. Bacteriol. (2001)-8-2405-2410.
STRATTON—"Characterization of Fiber-Fiber Bond Strength from Paper Mechanical Properties" (Abstract)—International Paper Physics Conference Proceedings (1996).
UNIPROT Accession No. A8J2S9—Chlorophyllase I (Dec. 4, 2007).
USPTO—Mar. 1, 2011—Office Action U.S. Appl. No. 11/575,066.
USPTO—Dec. 9, 2010—Office Action—U.S. Appl. No. 11/570,169.
USPTO—Jul. 21, 2011—Office Action—U.S. Appl. No. 11/817,865.
WITKOWSKI—Biochemistry (1999)-38-11643-11650.
CIPO—Aug. 5, 2011—Requisition—CA 2,515,583.
Drablos—"Identification of conserved residues in family of esterase and lipase sequences", Meth. Enz., 284, pp. 28-61, (1997).

| SEQ ID NOs | Description | NR Accession Code | NR evalue | Genera/Organism | Genes/Protein Description | Seq Protein Accession | Gene Seq Protein evalue | Gene Seq cDNA Description | Gene Seq cDNA Accession | Gene Seq cDNA evalue | Pred EC No. | DNA Identities | Protein Identities | DNA Protein Length | Protein NR Length | Protein Gene Seq NR ID | Gene Seq ID NR |
|---|---|---|---|---|---|---|---|---|---|---|---|---|---|---|---|---|---|
| 141, 142 | PUTATIVE LIPASE/ESTERASE PROTEIN [Ralstonia solanacearum]. | 17545158 | 8E-51 | Ralstonia solanacearum | DNA encoding hydrolase BD423. | ABG31301 | 1E-174 | DNA encoding hydrolase BD423. | ABK89956 | 0 | 3.1... | 927 | 308 | 927 | 308 | 99 | |
| 143, 144 | hypothetical protein [Geobacter metallireducens]. | 23054791 | 3E-48 | Geobacter metallireducens | Acetobacter pasteurianus racemic exo-norbornyl ester hydrolase. | AAR72124 | 2E-18 | Differentially expressed breast cancer associated cDNA #144. | ABX77606 | 0.21 | 3... | 843 | 280 | 894 | 297 | 37 | 55 |
| 145, 146 | hypothetical protein FG11258.1 [Gibberella zeae PH-1] | 42555662 | 3E-54 | Gibberella zeae PH-1 | Cephalosporin C acetylesterase probe EST22. | AAR28440 | 6E-49 | Drosophila melanogaster polypeptide of SEQ ID NO 24465. | ABL18271 | 0.74 | | 765 | 254 | | 231 | 43 | |

FIGURE 30A

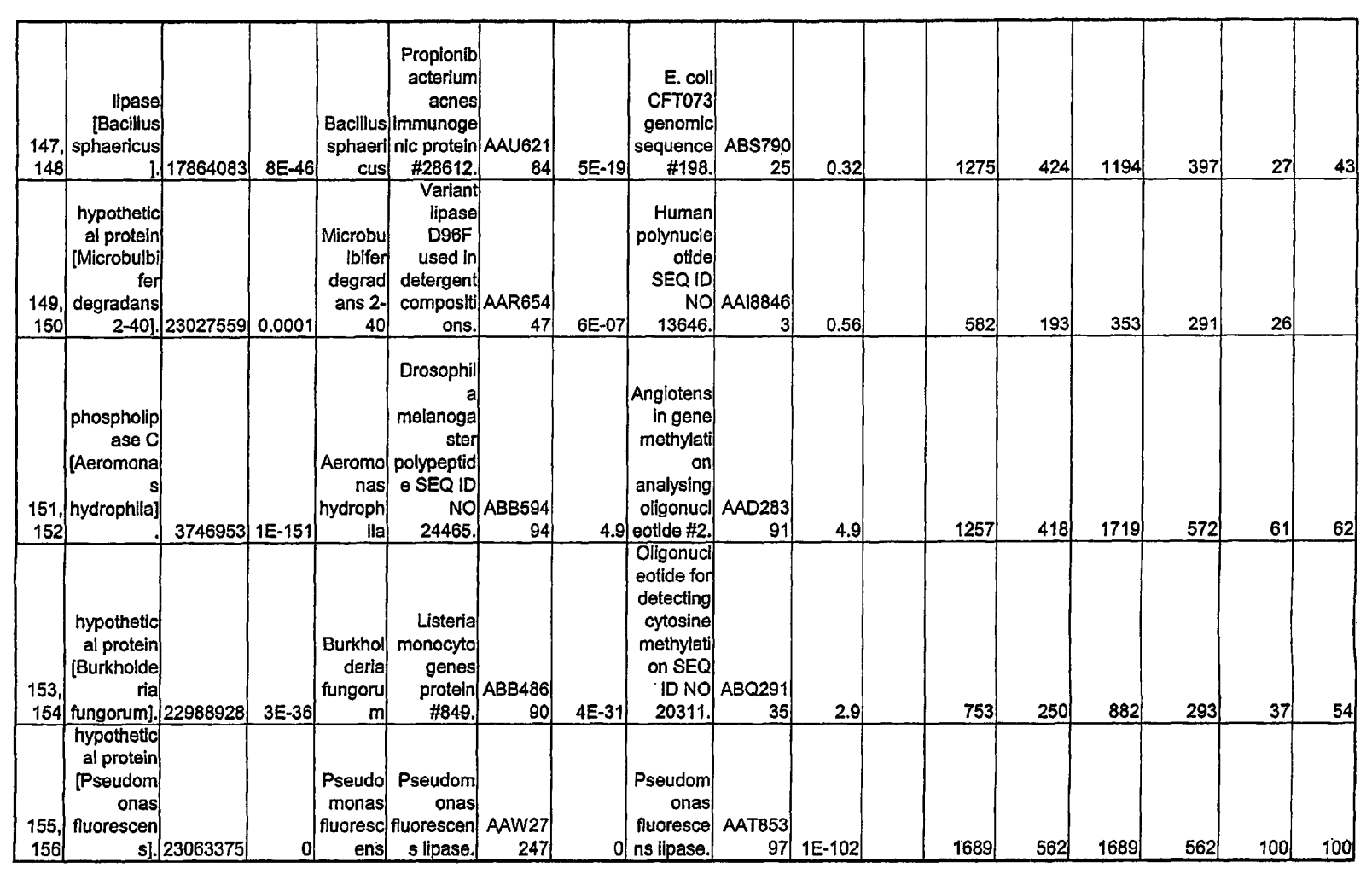

| | | | | | | | | | | |
|---|---|---|---|---|---|---|---|---|---|---|
| 147, 148 | lipase [Bacillus sphaericus] | 17864083 | 8E-46 | Bacillus sphaeri cus | Immunoge nic protein #

| | | | | | | | | | | |
|---|---|---|---|---|---|---|---|---|---|---|
| 157, 158 | hypothetical protein [Novosphingobium aromaticivorans] | 23110047 | 4E-64 | Novosphingobium aromaticivorans | Bifidobacterium longum NCC2705 ORF amino acid sequence SEQ ID NO:408. ABP656 59 | 2E-09 | Oligonucleotide for detecting cytosine methylation SEQ ID NO ABQ214 20311. 21 | 0.24 | | 960 | 319 | 981 | 326 | 43 | 56 |
| 159, 160 | probable lipase/esterase [Pirellula sp.] | 32471842 | 7E-17 | Pirellula sp. | DNA encoding hydrolase BD423. ABG313 05 | 8E-10 | Human secreted protein sequence encoded by gene #23. AAS014 71 | 0.25 | | 1002 | 333 | | 331 | 22 | |
| 161, 162 | lipase [Pseudomonas sp. UB48]. | 9963801 | 0 | Pseudomonas sp. UB48 | Mutant lipase coding sequence. AAY009 90 | 0 | Mutant lipase coding sequence AAX278 45 | 1E-29 | 3.4.24.40 | 1851 | 616 | 1854 | 617 | 65 | 70 |
| 163, 164 | hypothetical protein [Pseudomonas fluorescens]. | 23063374 | 0 | Pseudomonas fluorescens | Pseudomonas fluorescens lipase. AAW27 247 | 0 | Pseudomonas fluorescens lipase. AAT853 97 | 0 | 3.2.1. | 1854 | 617 | 1854 | 617 | 87 | 83 |
| 165, 166 | hypothetical protein [Desulfitobacterium hafniense]. | 23112865 | 1E-17 | Desulfitobacterium hafniense | | | Human HER2 (ErbB2) cDNA. ABK140 57 | 0.073 | | 312 | 103 | 9274 | 45 | | |

FIGURE 30C

| | | | | | | | | | |
|---|---|---|---|---|---|---|---|---|---|
| 167, 168 | esterase HDE [petroleum degrading bacterium HD-1] | 55099944 | 2E-57 | petroleum-degrading bacterium HD-1 | DNA encoding hydrolase | ABG31305 | 1E-53 | Ramoplanin biosynthetic ORF 20 protein. | AAL407 81 | 0.91 | | 936 | 311 | 954 | 317 | 42 | 58 |
| 169, 170 | probable triacylglycerol lipase [Chromobacterium violaceum ATCC 12472] | 34498169 | 1E-153 | Chromobacterium violaceum strain SD705 | lipase variant primer IN1. | AAY31185 | 5E-99 | Pseudomonas lipase gene. | AAT024 95 | 2E-23 | 3.1.1.3 | 933 | 310 | | 310 | 87 | |
| 171, 172 | putative hydrolase [Burkholderia sp. DBT1] | 153842091 | 1E-26 | Psychrobacter immobilis | lipase amino acid sequence. | AAB49668 | 3E-15 | Human ORFX protein sequence SEQ ID NO:1971 | ABN264 98 | 0.71 | | 735 | 244 | 831 | 276 | 30 | 49 |
| 173, 174 | tannase precursor [Xanthomonas campestris pv. campestris str. ATCC 33913] | 21231541 | 9E-92 | Xanthomonas campestris pv. campestris str. ATCC 33913 | Penicillin V amidohydrolase promoter fragment. | AAW00291 | 4E-70 | Human ORFX protein sequence SEQ ID NO:1971 | ABN265 67 | 1.6 | | 1578 | 525 | 1731 | 576 | 40 | 55 |

FIGURE 30D

| | | | | | | | | | | | |
|---|---|---|---|---|---|---|---|---|---|---|---|
| 175, 176 | hydrolase, alpha/beta hydrolase fold family [Caulobacter crescentus] | 16124639 | 2E-50 | Caulobacter crescentus | B glumae butinol I esterase fragment #4. | AAO175 33 | 1E-09 | Propionibacterium acnes immunogenic protein #28612. | AAS596 34 | 0.0009 | | 864 | 287 | 831 | 276 | 42 | 57 |
| 177, 178 | Glu-tRNA amidotransferase, subunit B [Aeropyrum pernix] | 14601911 | 0.82 | Aeropyrum pernix | Arabidopsis thaliana protein fragment SEQ ID NO: 76191. | AAG402 16 | | PCR primer used in site directed mutagenesis of Mit A K191A. | AAC558 42 | 4.3 | | | 798 | 265 | 1929 | 642 | 24 | 43 |
| 179, 180 | beta-hemolysin [Staphylococcus schleiferi]. | 3044072 | 4E-95 | Staphylococcus schleiferi | Staphylococcus epidermidis ORF amino acid sequence SEQ ID NO:5125. | ABP403 10 | 1E-88 | Human immune/hematopoietic antigen genomic sequence SEQ ID NO:4143 6. | AAK740 10 | 0.23 | 3.1.4.3 | 924 | 307 | 987 | 329 | 56 | 61 |

FIGURE 30E

| | | | | | | | | | |
|---|---|---|---|---|---|---|---|---|---|
| 181, 182 | putative lipase/esterase [Rhodopseudomonas palustris] emb\|CAE27866.1\| putative lipase/esterase [Rhodopseudomonas palustris CGA009] | 39935491 | 2E-81 | Rhodopseudomonas palustris BD423.s | DNA encoding hydrolase | ABG31305 | 2E-66 | Corynebacterium glutamicum MCT protein encoding DNA SEQ ID NO:459. | AAF67994 | 0.0003 | 3.1.1. | 1014 | 337 | 349980 | 314 | 42 |
| 183, 184 | hypothetical protein [Burkholderia fungorum] | 22989184 | 9E-42 | Burkholderia fungorum BD423.m | DNA encoding hydrolase | ABG31301 | 7E-43 | Bifidobacterium longum NCC2705 ORF amino acid sequence SEQ ID NO:408. | ABQ81847 | 0.23 | 3.1. | 924 | 307 | | 308 | 33 |
| 185, 186 | lipase [Pseudomonas sp. KB700A] | 15553087 | 0 | Pseudomonas sp. fluorescens KB700A | lipase protein. | AAY55925 | 0 | Candida cylindracea lipase gene. | AAT10419 | 0 | | 1425 | 474 | 1425 | 474 | 87 |
| 187, 188 | hypothetical protein [Haemophilus somnus 2336] | 32029881 | 9E-17 | Haemophilus somnus 2336 | Porphyromonas gingivalis protein PG27. | AAY34369 | 0.18 | Human secreted protein SEQ ID NO 792. | ABZ68161 | 0.41 | | 432 | 143 | | 164 | 26 | 85 |

FIGURE 30F

| | | | | | | | | | | |
|---|---|---|---|---|---|---|---|---|---|---|
| 189, 190 | esterase [Xylella fastidiosa 9a5c] | 15838344 | 1E-109 | Xylella fastidio sa 9a5c | DNA encoding hydrolase BD423. | ABG313 01 | 2E-32 | Bacillus licheniforⅿis genomic sequence tag (GST) #933. | ABK729 88 | 0.19 | 3.1.. | 774 | 257 | 1056 | 351 | 72 | 71 |
| 191, 192 | hypothetic al protein AN8500.2 [Aspergillu s nidulans FGSC A4] | 40747966 | 1E-58 | Aspergill us nidulan s FGSC A4 | Aspergillu s oryzae melO promoter, SEQ ID NO:5. | AAM49 420 | 2E-53 | Aspergillu s oryzae melO promoter, SEQ ID NO:5. | ABQ776 40 | 0.22 | | 882 | 293 | | 280 | 40 | |
| 193, 194 | polyuretha nase esterase A [Pseudom onas chlororaph is] | 4558791 | 0 | Pseudom onas chlorora phis | Mutant lipase coding sequence. | AAY009 90 | 0 | Pseudom onas fluoresce ns lipase protein. | AAZ227 04 | 0 | 3.4.24. 40 | 1848 | 615 | 1854 | 617 | 75 | 76 |
| 195, 196 | esterase [Acinetoba cter lwoffii] | 21070428 | 1E-172 | Acineto bacter lwoffii | Esterase amino acid sequence. | AAB357 39 | 1E-180 | Esterase amino acid sequence | AAC662 79 | 0 | 3.1.. | 1071 | 356 | 1189 | 356 | 28 | |
| 197, 198 | hypothetic al protein [Ralstonia metallidura ns] | 22975998 | 2E-85 | Ralstoni a metallid urans | C glutamicu m coding sequence fragment SEQ ID NO: 1935. | AAG911 26 | 6E-42 | Drosophil a melanoga ster polypepti de of SEQ ID NO 24465. | ABL076 74 | 1.4 | 3.5.1.4 | 1386 | 461 | 1485 | 494 | 39 | 52 |

FIGURE 30G

| | | | | | | | | | | |
|---|---|---|---|---|---|---|---|---|---|---|
| 199, 200 | putative esterase A [Streptomyces avermitilis MA-4680] | 29827845 | 5E-64 | Streptomyces avermitilis MA-4680 | Authentic ester hydrolase gene. | AAR106 76 | 1E-51 | Drosophila melanogaster polypeptide of SEQ ID NO 24465. | ABL075 35 | 1.3 | 1320 | 439 | | 388 | 34 | |
| 201, 202 | conserved hypothetical protein [Xanthomonas campestris pv. campestris str. ATCC 33913] | 21229637 | 1E-119 | Xanthomonas campestris pv. campestris str. ATCC 33913 | PCR primer used to amplify ORF122 of Neisseria species. | AAY387 78 | 4E-64 | Human protein phosphatase-4. | AAD240 26 | 1 3.4.21. | 1032 | 343 | 1038 | 345 | 65 | 71 |
| 203, 204 | triacylglycerol lipase [Geobacillus thermocatenulatus] | 1321706 | 6E-45 | Geobacillus thermocatenulatus | Staphylococcus epidermidis collagen binding lipase GehD. | AAE147 92 | 7E-41 | Arabidopsis thaliana stress regulated gene SEQ ID NO 1888. | ABZ174 25 | 0.29 3.1.1.3 | 1185 | 394 | 1254 | 417 | 29 | 44 |
| 205, 206 | lipase [Clostridium tetani E88] | 28210658 | 1E-113 | Clostridium tetani E88 | Staphylococcus epidermidis ORFs amino acid sequence SEQ ID NO:5125. | ABP397 23 | 5E-63 | Pathogen specific antigen related staphylococcal DNA SEQ ID No 198. | ABT149 01 | 5E-06 3.1.1.3 | 1278 | 425 | | 457 | 52 | |

FIGURE 30H

| | | | | | | | | |
|---|---|---|---|---|---|---|---|---|
| 207, 208 | lysophospholipase [Pyrococcus furiosus DSM 3638] | 18976852 | 1E-116 | Pyrococcus furiosus DSM 3638 | ABU569 26 | 1E-127 | 5' PCR primer used to amplify S. solfataricus P1-8LC esterase gene. | ABX767 41 | 2E-60 | 3.1.4.3 9 | 786 | 261 | 789 | 262 | 83 |
| 209, 210 | putative lipase activator protein | 28897954 | 8E-47 | | Pseudomonas protein-activated lipase B gene. | AAR773 17 | 2E-14 | Human polynucleotide SEQ ID NO 13646. | AAI8092 2 | 0.21 | | 858 | 285 | | 283 | 39 |
| 211, 212 | cellulase [Stigmatella aurantiaca] | 19572317 | 8E-96 | Stigmatella aurantiaca | Beta-1,4-endoglucanase Identity region #5. | AAY695 08 | 4E-33 | Streptococcus agalactiae PCR primer SEQ ID NO 11875. | ABN715 27 | 0.02 | 3.2.1.4 | 1266 | 421 | 1893 | 630 | 44 |
| 213, 214 | putative secreted lipase [Streptomyces avermitilis MA-4680] | 29833101 | 3E-28 | Streptomyces avermitilis MA-4680 | Corynebacterium glutamicum MCT protein encoding DNA SEQ ID NO:459. | AAB766 09 | 2E-23 | Pinus radiata transcription factor DNA sequence #409. | AAC573 09 | 0.83 | 3.1.1.3 | 855 | 284 | | 286 | 27 |

FIGURE 30I

| | | | | | | | | | |
|---|---|---|---|---|---|---|---|---|---|
| 215, 216 | conserved protein with a conserved patatin-like phospholipase domain [Bacteroides thetaiotaomicron VPI-5482] | 29346184 | 5E-46 | Bacteroides thetaiotaomicron VPI-5482 | ABU569 27 | 5' PCR primer used to amplify S. thetaiotaomicron VPI-5482 esterase gene. | 8E-42 | Drosophila melanogaster polypeptide of SEQ ID NO 24465. | ABL275 66 | 0.19 | 3.4.21.. | 783 | 260 | | 268 | 38 | |
| 217, 218 | lipase [uncultured bacterium] | 9454058 | 1E-62 | uncultured bacterium | AAR956 96 | Pseudomonas mendocina cutinase. | 1E-130 | Human cDNA encoding secreted protein #209. | ABK351 27 | 0.83 | | 849 | 282 | 1960 | 258 | 70 | |
| 219, 220 | ACETYL-HYDROLASE. | 1352065 | 2E-66 | Streptomyces hygroscopicus | ABG313 01 | DNA encoding hydrolase BD423. | 2E-50 | S. spinosa protein fragment encoded by ORF24, SEQ ID NO. 55. | AAF883 17 | 0.004 | 3.1.. | 891 | 296 | | 299 | 46 | 57 |
| 221, 222 | lytic enzyme [Xanthomonas axonopodis pv. citri str. 306] | 21241239 | 9E-62 | Xanthomonas axonopodis pv. citri str. 306 | AAB075 12 | Amino acid sequence of an intracellular beta-1,3-glucanase | 5E-07 | Mycobacterium tuberculosis strain H37Rv genome SEQ ID NO.2. | AAI9968 3 | 0.016 | | 1008 | 335 | 1770 | 589 | 50 | |

FIGURE 30J

| | | | | | | | | | | | |
|---|---|---|---|---|---|---|---|---|---|---|---|
| 223, 224 | lipase, putative [Deinococcus radiodurans] | 15805363 | 6E-62 | Deinococcus radiodurans | Staphylococcus epidermidis ORF amino acid sequence SEQ ID NO:5125. | ABP397 23 | 9E-35 | Human colon specific gene cDNA sequence SEQ ID NO:1074. | ABZ326 80 | 1.3 | 3.1.1.3 | 1359 | 452 | 1461 | 486 | 34 | 50 |
| 225, 226 | putative esterase A [Streptomyces avermitilis MA-4680] | 29827845 | 2E-86 | Streptomyces avermitilis MA-4680 | Authentic ester hydrolase gene. | AAR106 76 | 1E-66 | Drosophila melanogaster polypeptide of SEQ ID NO 24465. | ABL080 33 | 1.2 | | 1209 | 402 | | 388 | 45 | |
| 227, 228 | lipase; putative [Bacillus anthracis str. Ames] | 30262592 | 3E-73 | Bacillus anthracis str. Ames | Staphylococcus epidermidis ORF amino acid sequence SEQ ID NO:5125. | ABP392 09 | 2E-41 | Oligonucleotide for detecting cytosine methylation on SEQ ID NO 20311. | ABQ491 67 | 1.2 | 3.1.1.3 | 1266 | 421 | | 400 | 38 | |
| 229, 230 | lipase [Clostridium tetani E88] | 28210658 | 9E-73 | Clostridium tetani E88 | Staphylococcus aureus DNA for cellular proliferation protein #1219. | AAU343 45 | 1E-41 | T. niveum Cyclosporin synthetase. | AAQ543 86 | 1.3 | 3.1.1.3 | 1281 | 426 | | 457 | 42 | |

FIGURE 30K

| | | | | | | | | | | |
|---|---|---|---|---|---|---|---|---|---|---|
| 231, 232 | DNA-damage-inducible protein J [Vibrio cholerae]. | 15601089 | 2E-38 | Vibrio cholerae | Streptococcus agalactiae PCR primer SEQ ID NO 11875. | ABP257 90 | 5E-05 | Human ovarian antigen HCRCEO 2, SEQ ID NO:2287. | ABQ549 42 | 0.26 | | 279 | 279 | 92 | 92 | 82 | 77 |
| 233, 234 | carboxylesterase [Oceanobacillus iheyensis]. | 23099884 | 2E-81 | Oceanobacillus iheyensis | DNA encoding hydrolase BD423. | ABG313 03 | 2E-76 | DNA encoding hydrolase BD423. | ABK899 58 | 0.0002 | 3.1.1.1 | 651 | 741 | 216 | 246 | 63 | 69 |
| 235, 236 | hypothetical protein [Pseudomonas aeruginosa UCBPP-PA14] | 32037995 | 1E-107 | Pseudomonas aeruginosa UCBPP-PA14 | PMWaV-2 22.3 kDa protein of unknown function. | AAY919 73 | 0.16 | Methylomonas glucose 6 phosphate 1 dehydrogenase DNA SEQ ID:19. | ABL515 15 | 0.33 | | 1335 | 954 | 444 | 446 | 10 | |
| 237, 238 | esterase HDE [petroleum degrading bacterium HD-1]. | 5509944 | 5E-78 | petroleum-degrading bacterium HD-1 | DNA encoding hydrolase BD423. | ABG313 05 | 2E-70 | DNA encoding hydrolase BD423. | ABK899 60 | 1.1 | 3.1.1.1 | 1095 | | 364 | 317 | 42 | 50 |

FIGURE 30L

| | | | | | | | | | | |
|---|---|---|---|---|---|---|---|---|---|---|
| 239, 240 | hypothetical protein [Rhodospirillum rubrum] | 22966679 | 2E-43 | Rhodospirillum rubrum | DNA encoding hydrolase BD423. | ABG313 02 | 7E-36 | Protein fragment #32 of S. roseosporus biosynthetic gene cluster. | ABQ788 72 | 0.6 | 3.1.. | 615 | 204 | 326 | 45 |
| 241, 242 | hypothetical conserved protein [Oceanobacillus iheyensis] | 23099539 | 3E-54 | Oceanobacillus iheyensis | Bacillus cephalosporin C deacetylase ORF PCR primer #2. | AAY582 39 | 3E-39 | Bifidobacterium longum NCC2705 ORF amino acid sequence SEQ ID NO:408. | ABQ818 47 | 0.18 | | 735 | 244 | 696 | 231 | 41 | 42 |
| 243, 244 | lipase, putative [Deinococcus radiodurans] | 15805363 | 9E-81 | Deinococcus radiodurans | Staphylococcus epidermidis ORF amino acid sequence SEQ ID NO:5125. | ABP397 23 | 1E-45 | Drosophila melanogaster polypeptide de SEQ ID NO 24465. | ABL153 77 | 0.31 | 3.1.1.3 | 1260 | 419 | 1461 | 486 | 42 | 55 |
| 245, 246 | putative carboxylesterase [Salmonella typhimurium LT2] | 16764967 | 0 | Salmonella typhimurium LT2 | Para-Nitrobenzyl Esterase 3-H5, modified DNA. | AAY260 71 | 1E-66 | Drosophila melanogaster polypeptide de SEQ ID NO 24465. | ABL161 97 | 0.006 | 3.1.1.1 | 1506 | 501 | 1509 | 502 | 74 | 71 |

FIGURE 30M

| | | | | | | | | | | | |
|---|---|---|---|---|---|---|---|---|---|---|---|
| 247, 248 | bll4001 [Bradyrhiz obium japonicum] | 27379112 | 6E-81 | Bradyrhiz obium japonicum | An aminopoly ol amine oxidase for expressio n in Pichia. | AAY688 51 | 4E-73 | Previously undisclos ed canine gene #53. | ABL995 07 | 0.11 | 3.1.1.1 | 1695 | 564 | | 516 | 36 |
| | predicted Phospholip ase/Carbo xylesteras e [Leptospira interrogan s serovar | | | Leptospi ra interrog ans serovar | PCR primer used to amplify an ORF of Chlamydia | AAY370 | | | | | | | | | | |
| 249, 250 | lal str. 56601]. | 24216184 | 1E-41 | lal str. 56601 | trachomati s. | 64 | 7E-22 | DNA encoding novel human diagnosti c protein #20574. | AAS938 24 | 0.68 | | 705 | 234 | 708 | 235 | 36 |
| 251, 252 | AQUALYSI N I PRECURS OR. | 114081 | 1E-31 | Thermu s aquatic us | Aqualysin I. | AAR676 53 | 3E-32 | Human GENSET protein SEQ ID 456. | ABZ367 00 | 1.2 | 3.4.21. | 1215 | 404 | 541 | 513 | 27 |
| 253, 254 | latex allergen from Hevea brasiliensi s [Chromob acterium violaceum ATCC 12472] | 34495896 | 4E-51 | Chromo bacteriu m violace um ATCC 12472 | Arabidops is thaliana protein fragment SEQ ID NO: 76191. | AAG427 87 | 4E-22 | Arabidop sis thaliana protein fragment SEQ ID NO: 76191. | AAC424 05 | 0.058 | 3.1.1.4 | 927 | 308 | | 322 | 37 |

FIGURE 30N

| | | | | | | | | | | |
|---|---|---|---|---|---|---|---|---|---|---|
| 255, 256 | hypothetical protein [Ralstonia metallidurans] | gi\|22977842 | 3E-69 | Ralstonia metallidurans | B glumae butinol I esterase fragment #4. | AAO17533 | 3E-59 | Mycobacterium tuberculosis strain H37Rv genome SEQ ID NO 2. | AAI99683 | 0.91 | 3... | 933 | 310 | 969 | 322 | 45 | 57 |
| 257, 258 | hypothetical protein [Magnetospirillum magnetotacticum] | gi\|23012713 | 4E-43 | Magnetospirillum magnetotacticum | DNA encoding hydrolase BD423. | ABG31301 | 6E-37 | Mitochondrially-targeted aequorin gene reverse PCR primer. SEQ ID NO:61. | ABA91410 | 0.29 | 3.1... | 1152 | 383 | 960 | 319 | 31 | 47 |
| 259, 260 | hypothetical protein [Ralstonia metallidurans] | gi\|22977842 | 2E-77 | Ralstonia metallidurans | B glumae butinol I esterase fragment #4. | AAO17533 | 9E-62 | A. vitis hypersensitive response elicitor protein, SEQ ID NO:61. | AAA61506 | 0.015 | 3.1.1.2 4 | 930 | 309 | 969 | 322 | 46 | 60 |
| 261, 262 | hypothetical protein [Pseudomonas fluorescens] | gi\|23063374 | 0 | Pseudomonas fluorescens | Pseudomonas fluorescens lipase. | AAW27247 | 0 | Pseudomonas fluorescens lipase. | AAT85397 | 0 | 3.2.1. | 1854 | 617 | 1854 | 617 | 93 | 89 |

FIGURE 30O

| | | | | | | | | | | | |
|---|---|---|---|---|---|---|---|---|---|---|---|
| 263, 264 | slr6006 [Synechocystis sp. PCC 6803] ref\|NP_94 2508.1\| slr6065 [Synechocystis sp. PCC 6803] dbj\|BAD02 063.1\| slr6006 [Synechocystis sp. PCC 6803] dbj\|BAD02 122.1\| slr6065 [Synechocystis sp. PCC 6803] | 38505831 | 5E-26 | Synechocystis sp. PCC 6803 | Staphylococcus epidermidis ORFs amino acid sequence SEQ ID NO:5125. | ABP400 07 | 2E-11 | E. coli CFT073 genomic sequence #198. | ABS789 35 | 0.27 | 1092 | 363 | 1581 | 342 | 15 |
| 265, 266 | hypothetical protein [Chloroflexus aurantiacus] | 22971644 | 0.014 | Chloroflexus aurantiacus | Archaeoglobus venificus esterase SNP6-24LC. | AAW23 078 | 0.12 | Human lung tumour protein encoding cDNA #439. | ABK162 76 | 1.6 | 1632 | 543 | 527 | 11 | 42 |

FIGURE 30P

| | | | | | | | | | |
|---|---|---|---|---|---|---|---|---|---|
| lipase [Geobacillus thermoleovorans]. | 4835874 | 1E-156 | Geobacillus thermoleovorans | Staphylococcus aureus DNA for cellular proliferation protein #1219. | AAU374 83 | 3E-29 | Aspergillus fumigatus essential gene protein #821. | ABT207 06 | 3.1 | 3.1.1.3 | 807 | 268 | 1251 | 416 | 100 | 99 |
| 267, 268 | | | | | | | | | | | | | | | |
| hypothetical protein [Pseudomonas fluorescens]. | 23063375 | 0 | Pseudomonas fluorescens | Pseudomonas fluorescens lipase. | AAW27 247 | 0 | Pseudomonas fluorescens lipase. | AAT853 97 | 1E-143 | | 1689 | 562 | 1689 | 562 | 91 | 88 |
| 269, 270 | | | | | | | | | | | | | | | |
| similar to dihydrolipoamide S-acetyltransferase [Bacillus subtilis]. | 16080194 | 0.087 | Bacillus subtilis | Human ubiquitin carboxyl-terminal hydrolase UCH-1 conserved domain. | AAE241 60 | 0.61 | Arabidopsis thaliana protein fragment SEQ ID NO: 76191. | AAC480 61 | 0.73 | | 756 | 251 | 822 | 273 | 17 | 43 |
| 271, 272 | | | | | | | | | | | | | | | |
| hypothetical protein [Ralstonia metallidurans]. | 22980221 | 1E-128 | Ralstonia metallidurans | PCR primer used to amplify ORF122 of Neisseria species. | AAY387 78 | 3E-26 | Nucleotide sequence of Human haematopoietic signalling factor. | AAV419 06 | 0.56 | 3.4.21. | 2244 | 747 | 2370 | 789 | 38 | 51 |
| 273, 274 | | | | | | | | | | | | | | | |

FIGURE 30Q

| | | | | | | | | | | | | | | | | |
|---|---|---|---|---|---|---|---|---|---|---|---|---|---|---|---|---|
| 275, 276 | hypothetical protein Psyc103301 [Psychrobacter sp. 273-4] | 41689542 | 5E-72 | Psychrobacter sp. 273-4 | Authentic ester hydrolase gene. | AAR10676 | 7E-37 | Human genome-derived single exon probe ORF from lung SEQ ID No 13707. | ABS04916 | 1.2 | | 1260 | 419 | | 490 | 39 | |
| 277, 278 | putative carboxylesterase [Salmonella typhimurium LT2]. | 16764967 | 0 | Salmonella typhimurium LT2 | Fumonisin catabolising gene cluster isolation related oligonucleotide. | AAY80085 | 2E-63 | C. acidovorans polyurethane esterase. | AAV69212 | 0.002 | 3.1.1.1 | 1509 | 502 | 1509 | 502 | 82 | 76 |
| 279, 280 | lipO [Mycobacterium tuberculosis H37Rv]. | 15608564 | 4E-65 | Mycobacterium tuberculosis H37Rv | Herbicidally active polypeptide SEQ ID NO 2. | ABB91130 | 6E-12 | Human ovarian cancer related cDNA clone SEQ ID NO:2618. | ABL84717 | 4.8 | 3.1.1.1 | 1245 | 414 | 1263 | 420 | 39 | 53 |

FIGURE 30R

| | | | | | | | | | | |
|---|---|---|---|---|---|---|---|---|---|---|
| 281, 282 | lipase; putative [Bacillus anthracis str. Ames] | 30262592 | 1E-112 | Bacillus anthracis str. Ames | Staphylococcus epidermidis ORFs amino acid sequence SEQ ID NO:5125. | ABP397 23 | 4E-79 | Pathogen specific antigen related staphylococcal DNA SEQ ID No ABT150 198. 44 | 9E-14 | 3.1.1.3 | | | | 400 | 48 |
| 283, 284 | lactone-specific esterase [Pseudomonas fluorescens] | 3641341 | 1E-69 | Pseudomonas fluorescens | B glumae butinol I esterase fragment #4. | AAO175 33 | 2E-67 | Pinus radiata transcription factor DNA sequence #409. | AAC561 98 | 0.061 | 3.1.1.2 4 | 1254 | 417 | | |
| 285, 286 | acetolactate synthase, large subunit [Pyrococcus abyssi] | 14521546 | 3E-25 | Pyrococcus abyssi | Putative P. abyssi phenylalanyl-tRNA synthetase alpha subunit. | AAB963 55 | 8E-26 | Pseudomonas sp. strain SD705 lipase variant primer IN1. | AAZ093 44 | 0.098 | 4.1.3.1 8 | 966 | 321 | 999 | 332 | 43 |
| | | | | | | | | | | | | 411 | 136 | 946 | 579 | 43 |
| 287, 288 | hydrolase, alpha/beta hydrolase fold family [Chlorobium tepidum TLS] | 21673775 | 1E-52 | Chlorobium tepidum TLS | Herbicidally active polypeptide SEQ ID NO 2. | ABB922 72 | 1E-46 | Human prostate expression marker cDNA. | ABV545 74 | 0.25 | 3.7.1. | 996 | 331 | 888 | 295 | 36 |
| | | | | | | | | | | | | | | | | 46 |

FIGURE 30S

| | | | | | | | | | | | | | | | | | | |
|---|---|---|---|---|---|---|---|---|---|---|---|---|---|---|---|---|---|---|
| hypothetical protein [Rhodospirillum rubrum] | 22965460 | 8E-73 | Rhodospirillum rubrum | Herbicidally active polypeptide SEQ ID NO 2 | ABB934 | 36 | 2E-18 fragment | Streptomyces tendae nikkomycin nikG protein | AAZ244 | 86 | 0.24 | 3.1.1.2/3 | 966 | 321 | | 375 | 48 | 70 |
| 289, 290 | | | | | | | | | | | | | | | | | | |
| lipase [Pseudomonas sp. UB481] | 9963801 | 0 | Pseudomonas sp. UB48 | Mutant lipase coding sequence | AAY009 | 90 | 0 | Mutant lipase coding sequence | AAX278 | 45 | 4E-29 | 3.4.24.40 | 1851 | 616 | 1854 | 617 | 65 | |
| 291, 292 | | | | | | | | | | | | | | | | | | |
| Predicted hydrolases or acyltransferases, alpha/beta hydrolase superfamily [Leptospira interrogans serovar lai str. 56601] | 24215201 | 5E-28 | Leptospira interrogans serovar lai str. 56601 | Arabidopsis thaliana interrogans protein fragment SEQ ID NO: 76191 | AAG457 | 43 | 5E-13 | | | | | | 858 | 285 | 894 | 297 | 27 | 44 |
| 293, 294 | | | | | | | | | | | | | | | | | | |
| carboxylesterase family protein [uncultured bacterium 105] | 40062502 | 3E-39 | uncultured bacterium 105 | Herbicidally active polypeptide SEQ ID NO 2 | ABB911 | 30 | 6E-15 | INT PR6 primer for amplification of CYP71C3 v2a cDNA and genomic DNA | AAZ500 | 24 | 0.26 | 3.1.1.1 | 1050 | 349 | | 288 | 22 | |
| 295, 296 | | | | | | | | | | | | | | | | | | |

FIGURE 30T

| | | | | | | | | | | |
|---|---|---|---|---|---|---|---|---|---|---|
| lipase [Pseudomonas sp. KB700A]. | 15553087 | Pseudomonas sp. KB700A | Pseudomonas fluorescens lipase protein. | AAY559 25 | 0 | Candida cylindracea lipase gene. | AAT104 19 | 0 | 1500 | 499 | 1425 | 474 | 85 | 80 |
| similar to lipases [Listeria innocua]. | 16801259 | Listeria innocua | Listeria monocytogenes protein #849. | ABB484 16 | 4E-68 | Human polynucleotide SEQ ID NO 34. | ABQ667 93 | 2E-68 | 0.92 | 3.1.. | 945 | 314 | 13485 | 347 | 44 |
| Chain A, The Crystal Structure Of The Thermophilic Carboxylesterase Est2 From Alicyclobacillus Acidocaldarius. | 11513478 | Alicyclobacillus acidocaldarius | DNA encoding hydrolase BD423. | ABG313 05 | 1E-177 | DNA encoding hydrolase BD423. | ABK899 60 | 0 | 3.1.. | 933 | 310 | 933 | 310 | 100 |
| putative esterase [Streptomyces coelicolor A3(2)] | 21221842 | Streptomyces coelicolor A3(2) | DNA encoding hydrolase BD423. | ABG313 01 | 5E-54 | DNA encoding novel human diagnostic protein #20574. | AAS654 01 | 3E-45 | 0.051 | 3.1.. | 810 | 269 | 266 | 44 |

FIGURE 30U

| | | | | | | | | | |
|---|---|---|---|---|---|---|---|---|---|
| 305, 306 | lactonizing lipase | 28897955 | 1E-155 | | PCR primer used in the course of the invention. | AAW53 933 | 3E-96 | Nucleotide sequence of S.pneumoniae nusA gene. | AAZ371 19 | 0.058 | 3.1.1.3 | 927 | 308 | | 309 | 88 | |
| 307, 308 | hypothetical protein [Thermotoga maritima] | 15642808 | 3E-07 | Thermotoga maritima | Acetylxylan esterase. | AAB821 24 | 4E-05 | Human cytoskeleton-associated protein, CSAP-25. | AAD496 13 | 8 | | 2040 | 679 | 1188 | 395 | 12 | 26 |
| 309, 310 | esterase A [Streptomyces chrysomallus] | 3649751 | 2E-67 | Streptomyces chrysomallus | Authentic ester hydrolase gene. | AAR106 77 | 1E-52 | PCR primer #2 for S. atroolivaceus leinamycin gene cluster ORF-4. | ABX342 89 | 1.1 | 3.5.2.6 | 1161 | 386 | 1170 | 389 | 39 | 53 |
| 311, 312 | hemolysin [Vibrio harveyi] | 10998525 | 6E-61 | Vibrio harveyi | Arabidopsis thaliana protein fragment SEQ ID NO: 76191. | AAG247 20 | 6E-15 | Aspergillus oryzae polynucleotide SEQ ID NO 3150. | ABZ518 03 | 5 | | 1290 | 429 | 1257 | 418 | 32 | 48 |

FIGURE 30V

| | | | | | | | | | | |
|---|---|---|---|---|---|---|---|---|---|---|
| 313, 314 | lipase modulator protein [Chromobacterium violaceum ATCC 12472] | 34498168 | 1E-23 | Chromobacterium violaceum ATCC 12472 | Lipase gene. | AAR108 64 | 1E-20 | galK gene of S. lividans gal operon. | AAQ985 77 | 0.062 | | 987 | 328 | 783 | 303 | 28 | 52 |
| 315, 316 | conserved hypothetical protein [Chlorobium tepidum TLS] | 21674697 | 1E-59 | Chlorobium tepidum TLS | 5' PCR primer used to amplify S. solfataricus P1-8LC esterase gene. | ABU569 27 | 2E-33 | Fusarium venenatum EST SEQ ID NO:1176. | AAF143 75 | 0.75 | 3.4.21. | 771 | 256 | 783 | 260 | 47 | 47 |
| 317, 318 | unknown protein [Arabidopsis thaliana]. | 18377628 | 1E-28 | Arabidopsis thaliana | S. cinnamonensis MonAIV/p olyketide synthase multi-enzyme MONS4. | ABG998 84 | 5E-05 | Drosophila melanogaster polypeptide of SEQ ID NO 24465. | ABL090 45 | 0.76 | | 786 | 261 | 1512 | 503 | 37 | |
| 319, 320 | lactonizing lipase [Vibrio cholerae]. | 15600990 | 1E-107 | Vibrio cholerae | Pseudomonas mendocina SD702 lipase primer. | AAR852 65 | 3E-93 | Humicola lanuginosa lipase gene fragment PCR primer AAT615 4545. | AAT615 95 | 0.001 | 3.1.1.3 | 942 | 313 | 1020 | 339 | 62 | 58 |

FIGURE 30W

| | | | | | | | | | | | |
|---|---|---|---|---|---|---|---|---|---|---|---|
| acyl-CoA thioesterase [Leptospira interrogans serovar lai str. 56601] 321, 322 | 24215261 | Leptospira interrogans serovar lai str. 56601 | DNA encoding hydrolase BD423. | ABG313 02 | 3E-29 | Bacillus licheniformis genomic sequence tag (GST) #933. | ABK788 96 | 0.011 | | 672 | 223 | 633 | 210 | 42 | 49 |
| hypothetical protein [Chloroflexus aurantiacus] 323, 324 | 22972889 | Chloroflexus aurantiacus | Listeria monocytogenes protein #849. | ABB486 61 | 2E-07 | FLJ10193 fis clone HEMBA1 004763. | ABQ612 03 | 0.64 | | 660 | 219 | 669 | 222 | 28 | 45 |
| putative acyl-CoA thioesterase precursor [Rhodopseudomonas palustris] emb|CAE2 5639.1| putative acyl-CoA thioesterase precursor [Rhodopseudomonas palustris] 325, 326 | 39333272 | Rhodopseudomonas palustris | DNA encoding hydrolase BD423. | ABG313 02 | 2E-23 | Human protein isolated from skin cells SEQ ID NO: 331. | ABL350 90 | 2.6 | 3.1.2. | 672 | 223 | | 222 | 28 | |

FIGURE 30X

| | | | | | | | | | |
|---|---|---|---|---|---|---|---|---|---|
| 327, 328 | conserved hypothetical protein [Xanthomonas axonopodis pv. citri str. 306] | 212413345 | 1E-151 | Xanthomonas axonopodis pv. citri str. 306 | Streptococcus agalactiae PCR primer SEQ ID NO 11875. | ABP264 23 | 6E-06 | Human cDNA differentially expressed in granulocytic tic cells #55. | ABK843 49 | 0.084 | | 1329 | 442 | 1323 | 440 | 62 | 64 |
| 329, 330 | hypothetical protein [Burkholderia fungorum] | 229866634 | 3E-59 | Burkholderia cellulosum fungorum Orf 15. | Sorangium cellulosum protein Orf 15. | AAY585 81 | 3E-48 | Oligonucleotide for detecting cytosine methylation SEQ ID NO 20311. | ABQ440 39 | 1.2 3.5.2.6 | 1224 | 407 | 1200 | 399 | 34 | 51 |
| 331, 332 | lipO [Mycobacterium tuberculosis H37Rv] | 15608564 | 2E-63 | Mycobacterium tuberculosis H37Rv | Herbicidally active polypeptide SEQ ID NO 2. | ABB911 30 | 9E-12 | Drosophila melanogaster polypeptide of SEQ ID NO 24465. | ABL165 37 | 1.2 3.1.1.1 | 1245 | 414 | 1263 | 420 | 35 | 53 |
| 333, 334 | phospholipase A [Yersinia enterocolitica (type 0:8)] | 3201966 | 4E-14 | Yersinia enterocolitica (type 0:8) | Serratia sp heat resistant phospholipase A1 mutant TA13. | AAO148 57 | 5E-14 | Human digestive system antigen genomic sequence SEQ ID NO: 4885. | AAK898 56 | 1.1 | 1104 | 367 | 975 | 324 | 22 | 42 |

FIGURE 30Y

| | | | | | | | | | |
|---|---|---|---|---|---|---|---|---|---|
| 335, 336 | hypothetical protein [Novosphingobium aromaticivorans] | 23108137 | 1E-167 | Novosphingobium aromaticivorans | Partial protein sequence for S. venezuelae beta-glucosidase, ORF11. | ABG71664 | 0.86 | | | | | 1137 | 378 | 1116 | 371 | 75 | 72 |
| | | | | | | Human cDNA clone B01 SEQ ID NO:70. | ABA92973 | | | | | | | |
| 337, 338 | phospholipase A1 [Serratia sp. MK1] | 4775666 | 9E-13 | Serratia sp. MK1 | Serratia sp heat resistant phospholipase A1 mutant TA13. | AAO14856 | 3E-13 | Mycobacterium tuberculosis strain H37Rv genome SEQ ID NO 2. | AAI9968 3 | 1.1 | | 1104 | 367 | 4E+06 | 320 | 23 | |
| 339, 340 | lipase, putative [Deinococcus radiodurans] | 15805363 | 1E-85 | Deinococcus radiodurans | Staphylococcus epidermidis ORF amino acid sequence SEQ ID NO:5125. | ABP39209 | 6E-46 | S. cellulosum DNA encoding polyketide and hereropolyketide enzymes. | AAA11992 | 4.8 | 3.1.1.3 | 1245 | 414 | 1461 | 486 | 43 | 58 |
| 341, 342 | carboxylesterase [Chromobacterium violaceum ATCC 12472] | 34495813 | 1E-69 | Chromobacterium violaceum ATCC 12472 | DNA encoding hydrolase BD42305. | ABG31305 | 1E-34 | | | | 3.1... | 843 | 280 | | 268 | 46 | |

FIGURE 30Z

| | | | | | | | | | | |
|---|---|---|---|---|---|---|---|---|---|---|
| hypothetical protein [Microbulbifer degradans]. 343, 344 | 23026291 | 1E-12 | Microbulbifer degradans 2-40 | Arabidopsis thaliana protein fragment SEQ ID NO: AAG469 76191. 79 | 10 | Colony stimulating factor 1 receptor (CSF1R) oligonucleotide #205. AAS986 33 | 0.24 | | 981 | 326 | 996 | 331 | 19 | 42 |
| PHOSPHOLIPASE C PRECURSOR (PLC) (PHOSPHATIDYLCHOLINE CHOLINEPHOSPHOHYDROLASE) (CEREOLYSIN A). 345, 346 | 130081 | 2E-49 | Bacillus cereus | Listeria monocytogenes protein ABB476 #849. 76 | 7E-33 | Human immune/haematopoietic antigen genomic sequence SEQ ID NO:4143 AAK672 6. 82 | 0.35 | 3.1.4.3 | 1422 | 473 | | 283 | 25 | |
| beta-hemolysin [Staphylococcus schleiferi]. 347, 348 | 3044072 | 9E-96 | Staphylococcus schleiferi | Staphylococcus epidermidis ORF amino acid sequence SEQ ID NO:5125. ABP403 10 | 5E-90 | Buchnera sp. related PCR primer R SEQ ID NO:7. ABA927 87 | 0.015 | 3.1.4.3 | 963 | 320 | 987 | 329 | 55 | 60 |

FIGURE 30AA

| | | | | | | | | | |
|---|---|---|---|---|---|---|---|---|---|
| 349, 350 | conserved hypothetical protein [Bordetella parapertussis] | 33598428 | 3E-45 | Bordetella parapertussis | DNA encoding novel human diagnostic protein #20574. | ABG295 55 | 0.0001 | Human cDNA #466 differentially expressed In activated vascular tissue. | ABX635 94 | 0.56 | 579 | 192 | 1785 | 197 | 54 | 57 |
| 351, 352 | hypothetical protein [Burkholderia fungorum] | 22989154 | 1E-132 | Burkholderia fungorum | Gluconate dehydrogenase AAY057 m subunit III. | 19 | 1E-110 | cDNA encoding novel human connective tissue related polypeptide #266. | ABK425 29 | 1.8 | 1788 | 595 | | 594 | 42 | |
| 353, 354 | conserved hypothetical protein [Deinococcus radiodurans] | 15806930 | 2E-88 | Deinococcus radiodurans | Propionibacterium acnes Immunogenic protein #28612. | AAU447 27 | 2E-43 | Fruit fly ecdysone-inducible protein 75A (E75A). | AAD476 07 | 0.002 | 1728 | 575 | 786 | 261 | 28 | 30 |
| 355, 356 | hypothetical protein [Novosphingobium aromaticivorans] | 23110047 | 7E-62 | Novosphingobium aromaticivorans | Bifidobacterium longum NCC2705 ORF amino acid sequence SEQ ID NO:408. | ABP656 59 | 1E-08 | Drosophila melanogaster polypeptide SEQ ID NO 24465. | ABL149 95 | 3.8 | 987 | 328 | 981 | 326 | 43 | 51 |

FIGURE 30BB

| | | | | | | | | | | | | | | | | | |
|---|---|---|---|---|---|---|---|---|---|---|---|---|---|---|---|---|---|
| 357, 358 | Phospholipase C [Bacillus cereus ATCC 14579] | 30018852 | 1E-137 | Bacillus cereus ATCC 14579 | Listeria monocytogenes protein #849. | ABB47676 | 1E-49 | Human prostate cancer associated antigen nucleotide sequence SEQ ID:505. | AAF22890 | 0.053 | 3.1.4.3 | 849 | 282 | | 283 | 81 | |
| 359, 360 | conserved hypothetical protein-putative beta-lactamase or penicillin-binding protein [Pirellula sp.] | 32477786 | 2E-71 | Pirellula sp. | Ester hydrolase. | AAW94999 | 1E-45 | Pseudomonas sp. WF505 ORF6-6 protein, SEQ ID NO:11. | AAA38398 | 0.3 | 3.5.2.6 | 1197 | 398 | | 382 | 39 | |
| 361, 362 | Phospholipase C precursor (PLC) (Phosphatidylcholine cholinephosphohydrolase). | 23821963 | 0 | Clostridium sordellii | Clostridium perfringens alpha-toxin. | AAR52563 | 1E-121 | Mycoplasma genitalium genome. | AAT58840 | 0.019 | 3.1.4.3 | 1200 | 399 | | 399 | 100 | |

FIGURE 30CC

| | | | | | | | | | | | |
|---|---|---|---|---|---|---|---|---|---|---|---|
| 363, 364 | conserved hypothetical protein [Xanthomonas campestris pv. campestris str. ATCC 33913] | 21232725 | 0.0001 | Xanthomonas campestris pv. campestris str. ATCC 33913 | Rice neutral triacylglycerol lipase cDNA. | AAY323 12 | 0.028 | Psudomonas sp ABC transporter encoding DNA ORF0604 4. | AAF607 82 | 0.091 | | 1443 | 480 | 1347 | 448 | 13 | 42 |
| 365, 366 | conserved hypothetical protein [Methanosarcina acetivorans str. C2A] | 20089999 | 1E-30 | Methanosarcina acetivorans str. C2A | Listeria monocytogenes protein ABB493 #849. | 78 | 7E-28 | P. putida KT2440-associated DNA ORF0377 4. | AAF609 64 | 0.59 | | 609 | 202 | 639 | 212 | 37 | 49 |
| 367, 368 | lipase [Pseudomonas sp. KB700A] | 15553087 | 0 | Pseudomonas sp. KB700A | Pseudomonas fluorescens lipase protein. | AAY559 25 | 0 | Reverse primer to prepare a vector with protease gene. | ABL416 88 | 0 | | 1425 | 474 | 1425 | 474 | 91 | 86 |
| 369, 370 | putative secreted hydrolase [Streptomyces avermitilis MA-4680] | 29833119 | 3E-48 | Streptomyces avermitilis MA-4680 | C glutamicum coding sequence fragment SEQ ID NO: 1935. | AAG903 31 | 1E-11 | Mycobacterium tuberculosis strain H37Rv genome SEQ ID NO. 2. | AAI9968 3 | 0.19 | | 789 | 262 | 269 | 42 | | |

FIGURE 30DD

| | | | | | | | | | | | | | | | | | |
|---|---|---|---|---|---|---|---|---|---|---|---|---|---|---|---|---|---|
| 371, 372 | putative carboxylesterase [Salmonella typhimurium LT2]. | 16764967 | 0 | Salmonella typhimurium LT2 | Fumonisin catabolising gene cluster isolation related oligonucleotide. | AAY80085 | 4E-63 | Mycobacterium tuberculosis strain H37Rv genome SEQ ID NO 2. | AAI99683 | 0.006 | 3.1.1.1 | 1509 | 502 | 1509 | 502 | 82 | 77 |
| 373, 374 | acetyl xylan esterase [Aspergillus ficuum]. | 14326043 | 2E-77 | Aspergillus ficuum | Acetyl xylan esterase AXE I. | AAR25291 | 2E-73 | Goat beta globin transgene PCR primer SEQ ID NO 14. | ABN85750 | 2.9 | | 759 | 252 | 912 | 303 | 55 | 59 |
| 375, 376 | hypothetical protein [Burkholderia fungorum]. | 22989184 | 1E-41 | Burkholderia fungorum | DNA encoding hydrolase BD423. | ABG31301 | 8E-35 | Human ORFX protein sequence SEQ ID NO:19716. | ABN23332 | 4.1 | 3.1.. | 1050 | 349 | 957 | 318 | 31 | 48 |

FIGURE 30EE

| | | | | | | | | | |
|---|---|---|---|---|---|---|---|---|---|
| 377, 378 | Chain A, The Crystal Structure Of The Thermophilic Carboxylesterase Est2 From Alicyclobacillus Acidocaldarius | 11513478 | 7E-17 | Alicyclobacillus acidocaldarius | DNA encoding hydrolase BD423. | ABG31305 | 2E-17 | Novel human diagnostic and therapeutic gene #69. | AAS38459 | 0.26 | 3.1.1.1 | 1044 | 347 | 376 | 310 | 25 |
| 379, 380 | glycerol ester hydrolase [Staphylococcus epidermidis ATCC 12228] gb\|AAO06046.1\| glycerol ester hydrolase [Staphylococcus epidermidis ATCC 12228] | 27469321 | 0 | Staphylococcus epidermidis ATCC 12228 | Staphylococcus epidermidis ORF amino acid sequence SEQ ID NO:5125. | ABP39723 | 0 | Staphylococcus epidermidis ORF amino acid sequence SEQ ID NO:5125. | ABN92268 | 0 | 3.1.1.3 | 2049 | 682 | | 681 | 87 |

FIGURE 30FF

| | | | | | | | | | | |
|---|---|---|---|---|---|---|---|---|---|---|
| 381, 382 | conserved hypothetical protein [Porphyromonas gingivalis W83] | 34541487 | 1E-33 | Porphyromonas gingivalis W83 | ABJ047 10. | 3E-09 | Mycobacterium tuberculosis protein | AAZ581 83 095.a10. | 0.32 | Wheat DAHP synthetase cDNA clone w1n.pk0 1 | 1287 | 428 | 339 | 24 |
| | putative transposase protein [Oryza sativa (japonica cultivar-group)] gb\|AAK91 322.1\| Putative transposase protein [Oryza sativa (japonica cultivar-group)] gb\|AAP53 150.1\| putative transposase protein [Oryza sativa (japonica cultivar-group)] | | | | | | | | | | | | | |
| 383, 384 | | 375533122 | 0.3 | Oryza sativa (japonica cultivar-group) | AAP936 e. 51 | | Amino acid sequence of Mycoplasma gallisepticum (MG8) polypeptid | AAS595

| | | | | | | | | | |
|---|---|---|---|---|---|---|---|---|---|
| hypothetical protein [Microbulbifer degradans 2-40] | 23029605 | 1E-94 | Microbulbifer degradans 2-40 | ABU569 28 | 5' PCR primer used to amplify S. solfataricus P1-8LC esterase gene. | ABX767 43 | 0 | | 1017 | 1017 | 338 | 338 | 100 | 52 |
| hypothetical protein [Geobacter metallireducens] | 23054791 | 5E-39 | Geobacter metallireducens | ABB916 74 | Herbicidally active polypeptide SEQ ID NO 2. | ABX169 09 | 2E-21 | 3... | 831 | 894 | 276 | 297 | 34 |
| hypothetical protein [Magnetococcus sp. MC-1] | 23000389 | 1E-113 | Magnetococcus sp. MC-1 | AAU335 60 | Staphylococcus aureus DNA for cellular proliferation protein #1219. | AAS514 19 | 2E-64 | 0.81 | | 915 | 945 | 304 | 314 | 64 | 64 |
| hypothetical protein [Ralstonia metallidurans] | 22977842 | 2E-55 | Ralstonia metallidurans | AAO175 33 | B glumae butinol I esterase fragment #4. | ABL088 37 | 1E-53 | 0.004 | 2... | | | | |
| | | | | | Drosophila melanogaster polypeptide of SEQ ID NO 24465. | | | 0.23 | | 942 | 969 | 313 | 322 | 40 | 53 |

FIGURE 30HH

| | | | | | | | | | | |
|---|---|---|---|---|---|---|---|---|---|---|
| 393, 394 | Chain B, Brefeldin A Esterase, A Bacterial Homologue Of Human Hormone Sensitive Lipase. | 4558169 | 5E-85 | Bacillus subtilis | DNA encoding hydrolase BD423. | ABG313 07 | 1E-46 | SR protein-specific kinase-1 protein, SEQ ID No 18. | AAL542 12 | 4.2 | | 1092 | 363 | | 361 | 45 | |
| 395, 396 | hypothetical protein [Desulfovibrio desulfuricans G20] | 23475355 | 0.32 | Desulfovibrio desulfuricans G20 | | ABB617 98 | 2.6 | Partial Drosophila melanogaster polypeptide SEQ ID NO 24465. | | 1.5 | | 408 | 135 | 276 | 91 | 21 | 36 |
| 397, 398 | hypothetical protein [Burkholderia fungorum] | 22983117 | 0.019 | Burkholderia fungorum | Lactococcus lactis protein ps123. | ABB547 73 | 0.49 | Mouse DST REC5_24 gene associated with atherosclerosis. | ABA985 39 AAD491 56 | 1.2 | | 1176 | 391 | 1602 | 533 | 20 | 49 |
| 399, 400 | hypothetical protein [Burkholderia fungorum] | 22986931 | 0 | Burkholderia fungorum | Penicillin V amidohydrolase promoter fragment. | AAW00 291 | 2E-26 | Mycobacterium tuberculosis strain H37Rv genome SEQ ID NO 2. | AAI9968 3 | 0.11 | | 1704 | 567 | 1740 | 579 | 57 | 64 |

FIGURE 30II

| | | | | | | | | | | | | | | | | | |
|---|---|---|---|---|---|---|---|---|---|---|---|---|---|---|---|---|---|
| 401, 402 | hydrolase; alpha/beta fold family [Bacillus anthracis str. Ames] | 30263757 | 1E-123 | Bacillus anthracis str. Ames | 5' PCR primer used to amplify S. solfataricus P1-8LC esterase gene. | ABU56923 | 1E-14 | BAC containing repeats from centromeres 1-4 #16. | AAF22305 | 0.19 | 3.1.1.1 | 774 | 257 | | 257 | 81 | |
| 403, 404 | conserved hypothetical protein [Agrobacterium tumefaciens str. C58 (U. Washington)]. | 17935644 | 1E-31 | Agrobacterium tumefaciens str. C58 (U. Washington) | PCR primer used to amplify ORF122 of Neisseria species. | AAY38779 | 7E-29 | Streptococcus agalactiae PCR primer SEQ ID NO 11875. | ABN71527 | 0.9 | 3.4.21. | 921 | 306 | 939 | 312 | 31 | 45 |
| 405, 406 | esterase [Pyrobaculum calidifontis]. | 22038183 | 1E-61 | Pyrobaculum calidifontis | DNA encoding hydrolase BD423. | ABG31305 | 1E-60 | Mycobacterium tuberculosis strain H37Rv genome SEQ ID NO 2. | AAI99683 | 3E-07 | 3.1.. | 939 | 312 | 942 | 313 | 43 | 53 |
| 407, 408 | streptothricin acetyl-transferase [Shigella sonnei]. | 20336343 | 1E-16 | Shigella sonnei | Kurthia sp. bioHII gene-encoded polypeptide. | AAW30522 | 5E-09 | Human zinc finger transcription factor RFLAT-1. | AAA50460 | 0.37 | | 390 | 129 | 843 | 280 | 34 | 46 |

FIGURE 30JJ

| | | | | | | | | | | | | | | | | | |
|---|---|---|---|---|---|---|---|---|---|---|---|---|---|---|---|---|---|
| 409, 410 | AGR_C_4582p [Agrobacterium tumefaciens]. | 15889787 | 0.19 | Agrobacterium tumefaciens | Arabidopsis thaliana protein fragment SEQ ID NO: 76191. | AAG48814 | 0.26 | Peptide #2, to design primer which is used to clone T. gondii CPSII. | AAD12308 | 0.85 | | 873 | 290 | 1371 | 456 | 16 | 49 |
| 411, 412 | carboxylesterase family protein [Caulobacter crescentus]. | 16126537 | 3E-75 | Caulobacter crescentus | Herbicidally active polypeptide SEQ ID NO 2. | ABB91130 | 2E-20 | Saccharopolyspora busR butenyl-spinosyn biosynthetic gene product. | ABV75558 | 0.22 | 3.1.1.3 | 879 | 292 | 870 | 289 | 51 | 59 |
| 413, 414 | probable hydrolase [Pseudomonas aeruginosa]. | 15596026 | 1E-54 | Pseudomonas aeruginosa | Pseudomonas aeruginosa esterase (estA) encoding DNA SEQ ID NO:3. | ABB09181 | 2E-17 | Arabidopsis thaliana stress regulated gene SEQ ID NO 1888. | ABZ14327 | 0.98 | 3.7.1. | 1005 | 334 | | 313 | 35 | |
| 415, 416 | cephalosporin-C deacetylase [Bacteroides thetaiotaomicron VPI-5482] | 29347935 | 2E-73 | Bacteroides thetaiotaomicron VPI-5482 | Bacillus subtilis serine protease SP1 (YUXL). | AAW97793 | 3E-35 | Signal transduction associated gene modified complementary DNA #131. | ABK31375 | 0.99 | 3.1.1.41 | 1014 | 337 | | 452 | 42 | |

FIGURE 30KK

| | | | | | | | | | |
|---|---|---|---|---|---|---|---|---|---|
| COG0596: Predicted hydrolases or acyltransferases (alpha/beta hydrolase superfamily) [Pseudomonas aeruginosa UCBPP-PA14] | 3E-36 | Pseudomonas aeruginosa UCBPP-PA14 | Pseudomonas aeruginosa estA encoding a esterase (estA) DNA SEQ ID NO:3. | ABB09181 | 9E-37 | Mouse Ischaemic condition related cDNA sequence SEQ ID NO:1012. | AB199344 | 0.22 | | 879 | 292 | 6734 | 315 | 30 | 53 |
| 417, 418 | 32038021 | | | | | | | | | | | | | | |
| conserved hypothetical protein [Caulobacter crescentus] | 1E-104 | Caulobacter crescentus | Sorangium cellulosum protein Orf 15. | AAY58581 | 1E-40 | Drosophila melanogaster polypeptide de SEQ ID NO 24465. | ABL13900 | | 1.3.3.5.2.6 | 1275 | 424 | 1440 | 479 | 48 | 52 |
| 419, 420 | 16127858 | | | | | | | | | | | | | | |
| lipase [Geobacillus stearothermophilus] | 2E-80 | Geobacillus stearothermophilus | Staphylococcus epidermidis ORF s amino acid sequence SEQ ID NO:5125. | ABP39209 | 3E-59 | Human cDNA SEQ ID NO 201. | ABQ93320 | 0.3 | 3.1.1.3 | 1215 | 404 | 1257 | 418 | 44 | 44 |
| 421, 422 | 167755790 | | | | | | | | | | | | | | |

FIGURE 30LL

| | | | | | | | | | | |
|---|---|---|---|---|---|---|---|---|---|---|
| 423, 424 | lipase [Pseudomonas sp. JZ-2003] | 34148611 | 0 | Pseudomonas sp. JZ-2003 | Mutant lipase coding sequence. | AAY009 90 | 0 | Mutant lipase coding sequence | AAX278 45 | 1E-38 | | | | 1851 | 616 | 1854 | 617 | 70 | 71 |
| 425, 426 | putative secreted lipase [Streptomyces avermitilis MA-4680] | 29833101 | 1E-27 | Streptomyces avermitilis MA-4680 | Propionibacterium acnes immunogenic protein #28612. | AAU477 38 | 5E-22 | Probe for Lipase B gene from Pseudomonas fragi #1219. 22,39 B. | AAQ402 35 | 0.047 | 3.1.1.3 | 759 | 252 | 286 | | 34 | |
| 427, 428 | lipase [Pseudomonas sp. B11-1] | 2853612 | 2E-63 | Pseudomonas sp. B11-1 | DNA encoding hydrolase BD423. | ABG313 05 | 1E-53 | Staphylococcus aureus DNA for cellular proliferation protein #1219. | AAS543 11 | 3.6 | 3.1.1. | 942 | 313 | 927 | 308 | 44 | 55 |
| 429, 430 | bll4284 [Bradyrhizobium japonicum] | 27379395 | 1E-59 | Bradyrhizobium japonicum | Archaeoglobus venificus esterase SNP6-24LC. | AAW23 083 | 1E-164 | Archaeoglobus venificus esterase SNP6-24LC. | AAT793 36 | 0 | 3.1.1.1 | 1032 | 343 | 914 | 304 | 83 | |
| 431, 432 | hypothetical protein [Thermotoga maritima] | 15642808 | 1E-11 | Thermotoga maritima | Staphylococcus aureus DNA for cellular proliferation protein #1219, #303. | AAU361 97 | 4E-10 | Listeria innocua DNA sequence | ABQ692 45 | 0.65 | | 672 | 223 | 1188 | 395 | 26 | 45 |

FIGURE 30MM

| | | | | | | | | | | |
|---|---|---|---|---|---|---|---|---|---|---|
| 433, 434 | carboxylesterase [Oceanobacillus iheyensis] | 23099884 | 8E-96 | Oceanobacillus iheyensis lipase. | Sequence of new-AAP953 75 | 1E-86 | Staphylococcus epidermidis ORF amino acid sequence SEQ ID NO:5125. | ABN933 44 | 0.0002 | 3.1.1.1 | 750 | 249 | 741 | 246 | 65 | 86 |
| 435, 436 | hypothetical protein MG00837.4 [Magnaporthe grisea 70-15] | 38102326 | 2E-05 | S. Magnaporthe kanlharae grisea nsis 70-15 PKSE protein. | ABG974 52 | 0.68 | E.coli OmpA signal-Chromobacterium triglyceride lipase fusion. | AAQ626 22 | 0.24 | | 957 | 318 | | 625 | 23 | 45 |
| 437, 438 | hypothetical protein [Nostoc punctiforme] | 23125906 | 1E-110 | TutB protein of toluene degrading bacterium T1. Nostoc punctiforme | AAW83 068 | 2E-40 | S. cellulosum DNA encoding polyketide and hereropolyketide enzymes. | AAA119 92 | 0.008 | 2.7.3 | 2085 | 694 | 2106 | 701 | 38 | |
| 439, 440 | PROBABLE ESTERASE/LIPASE PROTEIN [Ralstonia solanacearum] | 17546491 | 5E-78 | Archaeoglobus venificus esterase SNP6-24LC. Ralstonia solanacearum | AAW23 080 | 2E-48 | M. capsulatus gene #766 for DNA array. | ABQ910 84 | 0.23 | 3.1 | 918 | 305 | 1035 | 344 | 47 | 56 |

FIGURE 30NN

| | | | | | | | | | | | | | | | | | |
|---|---|---|---|---|---|---|---|---|---|---|---|---|---|---|---|---|---|
| 441, 442 | conserved hyperthetical protein [Leptospira interrogans serovar lai str. 56601]. | 24217208 | 7E-41 | Leptospira interrogans serovar lai str. 56601 | Listeria monocytogenes protein #849. | ABB49502 | 2.9 | Human protease gene. | ABX13671 | 0.62 | | 639 | 212 | 648 | 215 | 41 | 55 |
| 443, 444 | hypothetical protein [Novosphingobium aromaticivorans]. | 23109687 | 2E-60 | Novosphingobium aromaticivorans | 5' PCR primer used to amplify S. solfataricus P1-8LC esterase gene. | ABU56930 | 7E-55 | Propionibacterium acnes immunogenic protein #28612. | AAS59516 | 0.99 | 3.1.. | 1014 | 337 | 927 | 308 | 39 | 49 |
| 445, 446 | Conserved hypothetical protein [Chromobacterium violaceum ATCC 12472] | 34497475 | 2E-28 | Chromobacterium violaceum ATCC 12472 | Herbicidally active polypeptide SEQ ID NO 2. | ABB90899 | 3E-08 | Drosophila melanogaster polypeptide SEQ ID NO 24465. | ABL14687 | 0.41 | | 429 | 142 | | 130 | 44 | |
| 447, 448 | 2-amino-3-ketobutyrate coenzyme A ligase [Vibrio cholerae]. | 15601641 | 1E-147 | Vibrio cholerae | Staphylococcus aureus DNA for cellular proliferation protein #1219. | AAU34797 | 1E-120 | DNA encoding novel human diagnostic protein #20574. | AAS93008 | 4E-06 | 2.3.1.29 | 876 | 291 | 1194 | 397 | 89 | 78 |

FIGURE 30OO

| | | | | | | | | | | | | | | | | |
|---|---|---|---|---|---|---|---|---|---|---|---|---|---|---|---|---|
| 449, 450 | Sphingomyelin phosphodiesterase [Bacillus cereus ATCC 14579] | 30018853 | 6E-34 | Bacillus cereus ATCC 14579 | Staphylococcus epidermidis ORF amino acid sequence SEQ ID NO:5125. | ABP40310 | 8E-34 | Human cDNA clone (3'-primer) SEQ ID NO:5589. | AAH05989 | 0.98 | 3.1.4.3 | 999 | 332 | | 333 | 33 | |
| 451, 452 | conserved hypothetical protein [Vibrio cholerae]. | 15642542 | 1E-61 | Vibrio cholerae | Haemophilus influenzae strain A840164 BASB207 protein. | AAU96927 | 8E-50 | Bovine EST associated with lactation/muscle/fat deposition #5642. | ABX49873 | 2.7 | | 2775 | 924 | 3765 | 1254 | 21 | 46 |
| 453, 454 | lipase, putative [Deinococcus radiodurans]. | 15805363 | 9E-66 | Deinococcus radiodurans | Staphylococcus epidermidis ORF amino acid sequence SEQ ID NO:5125. | ABP39209 | 2E-40 | Human metastasis associated gene SEQ ID NO: 93. | ABL34573 | 5.2 | 3.1.1.3 | 1347 | 448 | 1461 | 486 | 35 | 54 |
| 455, 456 | lipase; putative [Bacillus anthracis str. Ames] | 30262592 | 1E-117 | Bacillus anthracis str. Ames | Staphylococcus epidermidis ORF amino acid sequence SEQ ID NO:5125. | ABP39209 | 3E-83 | Human immune system associated gene SEQ ID NO: 59. | ABL33672 | 0.31 | 3.1.1.3 | 1239 | 412 | | 400 | 48 | |

FIGURE 30PP

| | | | | | | | | | |
|---|---|---|---|---|---|---|---|---|---|
| 457, 458 | hypothetical protein Mbur0900_01 [Methanococcoides burtonii DSM 6242] | 41719874 | 1E-59 | Methanococcoides burtonii DSM 6242 | L. meyeri metX DNA amplifying primer P2. | AAB480 06 | 4E-50 | Mycobacterium tuberculosis strain H37Rv genome SEQ ID NO 2. | AAI9968 3 | 2.3.1.3 0.3 | 1 | 1194 | 397 | 488 | 31 | |
| 459, 460 | hypothetical protein FG10020. 1 [Gibberella zeae PH-1] | 42544838 | 3E-25 | Gibberella zeae PH-1 | Mature Pseudomonas pseudoalcaligenes lipase S155R variant. | AAR880 11 | 3E-11 | Drosophila melanogaster polypeptide of SEQ ID NO 24465. | ABL174 45 | | | | | | | |
| 461, 462 | Y4lI [Rhizobium sp. NGR234]. | 16519782 | 4E-07 | Rhizobium sp. NGR234 DNA SEQ ID No 37. | Mouse BACE-Interacting protein encoding | ABJ252 81 | 1.2 | Orthosomycin biosynthetic polypeptide of SEQ ID NO 273. | ABZ668 11 | 3.2 3.1.1.3 2.2 | 834 | 2205 | 277 | 2112 | 734 | 703 | 351 | 28 | 14 | 43 |
| 463, 464 | polyurethanase esterase A [Pseudomonas chlororaphis]. | 4558791 | 0 | Pseudomonas chlororaphis | Mutant lipase coding sequence. | AAY009 90 | 0 | Mutant lipase coding sequence | AAX278 45 | 3.4.24. 0 40 | 1854 | 1854 | 617 | 617 | 93 | 91 |

FIGURE 30QQ

| | | | | | | | | | | |
|---|---|---|---|---|---|---|---|---|---|---|
| 465, 466 | putative lipase/esterase [Rhodopseudomonas palustris] emb|CAE27866.1| putative lipase/esterase [Rhodopseudomonas palustris] CGA009 | 39935491 | 6E-74 | Rhodopseudomonas palustris | Archaeoglobus veniflicus esterase SNP6-24LC. | AAW23083 | 6E-68 | DNA encoding hydrolase BD423. | ABK899 60 | 4E-06 | 3.1.. | 1038 | 345 | 314 | 39 |
| 467, 468 | hypothetical protein gsr4153 [Gloeobacter violaceus] dbj|BAC92094.1| gsr4153 [Gloeobacter violaceus PCC 7421] | 37523722 | 6E-29 | Gloeobacter violaceus | Drosophila melanogaster polypeptide SEQ ID NO 24465. | ABB713 96 | 6E-05 | Drosophila melanogaster polypeptide SEQ ID NO 24465. | ABL044 97 | 0.98 | | 267 | 88 | 84 | 29 |

FIGURE 30RR

| | | | | | | | | | | |
|---|---|---|---|---|---|---|---|---|---|---|
| 469, 470 | probable hydrolase [Pseudomonas aeruginosa] | 15596026 | 6E-50 | Pseudomonas aeruginosa osa | Pseudomonas aeruginosa esterase (estA) encoding DNA SEQ ID NO:3. | ABB091 81 | 1E-15 | M. capsulatus gene #766 for DNA array. | ABQ902 88 | 0.061 | 3.1.1.2 4 | 975 | 324 | | 313 | 37 | |
| 471, 472 | putative esterase A [Streptomyces avermitilis MA-4680] | 29827845 | 8E-53 | Streptomyces avermitilis MA-4680 | Authentic ester hydrolase gene. | AAR106 77 | 3E-43 | Human tumour necrosis factor analogue. | AAQ144 67 | 0.001 | 3.5.2.6 | 1185 | 394 | | 388 | 33 | |
| 473, 474 | hypothetical protein [Novosphingobium aromaticivorans] | 231109771 | 4E-29 | Novosphingobium aromaticivorans | Arabidopsis thaliana protein fragment SEQ ID NO: 76191. | AAG385 17 | 7E-07 | FLJ10193 fis clone HEMBA1 004763. | ABQ611 52 | 1.7 | | 453 | 150 | 465 | 154 | 44 | 53 |
| 475, 476 | PROBABLE LIPOPROTEIN SIGNAL PEPTIDE [Ralstonia solanacearum]. | 17549469 | 5E-08 | Ralstonia solanacearum | T. fusca ester group cleaving enzyme protein fragment. | AAB860 32 | 4E-06 | Drosophila melanogaster polypeptide SEQ ID NO 24465. | ABL106 86 | 0.29 | | 1158 | 385 | 1119 | 372 | 20 | 47 |

FIGURE 30SS

| | | | | | | | | | | | |
|---|---|---|---|---|---|---|---|---|---|---|---|
| 477, 478 | lipase [uncultured bacterium] | 9454058 | 2E-78 | uncultured bacterium | Pseudomonas mendocina cutinase. | AAR956 96 | 1E-65 | Amino acid sequence of FK-520 PKS gene cluster module 8. | AAA146 51 | 0.22 | | 885 | 294 | 846 | 281 | 52 | 63 |
| 479, 480 | lipase [Clostridium tetani E88] | 28210658 | 3E-71 | Clostridium tetani E88 | Staphylococcus aureus DNA for cellular proliferation protein #1219. | AAU343 45 | 3E-71 | Lung small cell carcinoma antigen, cDNA #259. | AAS618 07 | 1E-39 | 1.3 3.1.1.3 | 1272 | 423 | | 457 | 41 | |
| 481, 482 | carboxylesterase [Oceanobacillus iheyensis] | 23099884 | 9E-97 | Oceanobacillus iheyensis | Sequence of new lipase. | AAP953 75 | 2E-87 | Staphylococcus epidermidis ORF amino acid sequence SEQ ID NO:5125. | ABN933 44 | 0.047 3.1.1.1 | 750 | 249 | 741 | 246 | 65 | 66 |

FIGURE 30TT

| | | | | | | | | | | | |
|---|---|---|---|---|---|---|---|---|---|---|---|
| 483, 484 | hypothetical protein [Archaeoglobus fulgidus] | 11498734 | 1E-157 | Archaeoglobus fulgidus | Murine TANGO 273cDNA. | AAB660 86 | 5E-06 | Human Immune/h aematopo ietic antigen genomic sequence SEQ ID NO:4143 6. | AAK798 20 | 0.34 | | | | | 60 | 60 |
| 485, 486 | hypothetical protein [Pseudomonas fluorescens] | 230633370 | 0 | Pseudomonas fluorescens | Listeria monocyto genes protein #849. | ABB484 32 | 1E-120 | DNA encoding novel human diagnostic protein #20574. | AAS931 48 | 0.14 | 1365 | 454 | 1371 | 456 | 75 | 73 |
| 487, 488 | polyurethanase esterase A [Pseudomonas chlororaphis] | 4558791 | 0 | Pseudomonas chlororaphis | Mutant lipase coding sequence. | AAY009 90 | | Mutant lipase coding sequence | AAX278 45 | 3.4.24.40 0 | 2283 | 760 | 2349 | 782 | 99 | 99 |
| 489, 490 | probable lipase [Pirellula sp.] | 32474016 | 1E-14 | Pirellula sp. | Phospholipase useful for edible oil degumming. | AAY320 85 | 8E-12 | Human Immune/h aematopo ietic antigen genomic sequence SEQ ID NO:4143 6. | AAK784 65 | 0.24 | 1854 951 | 617 316 | 1854 | 617 342 | 22 |

FIGURE 30UU

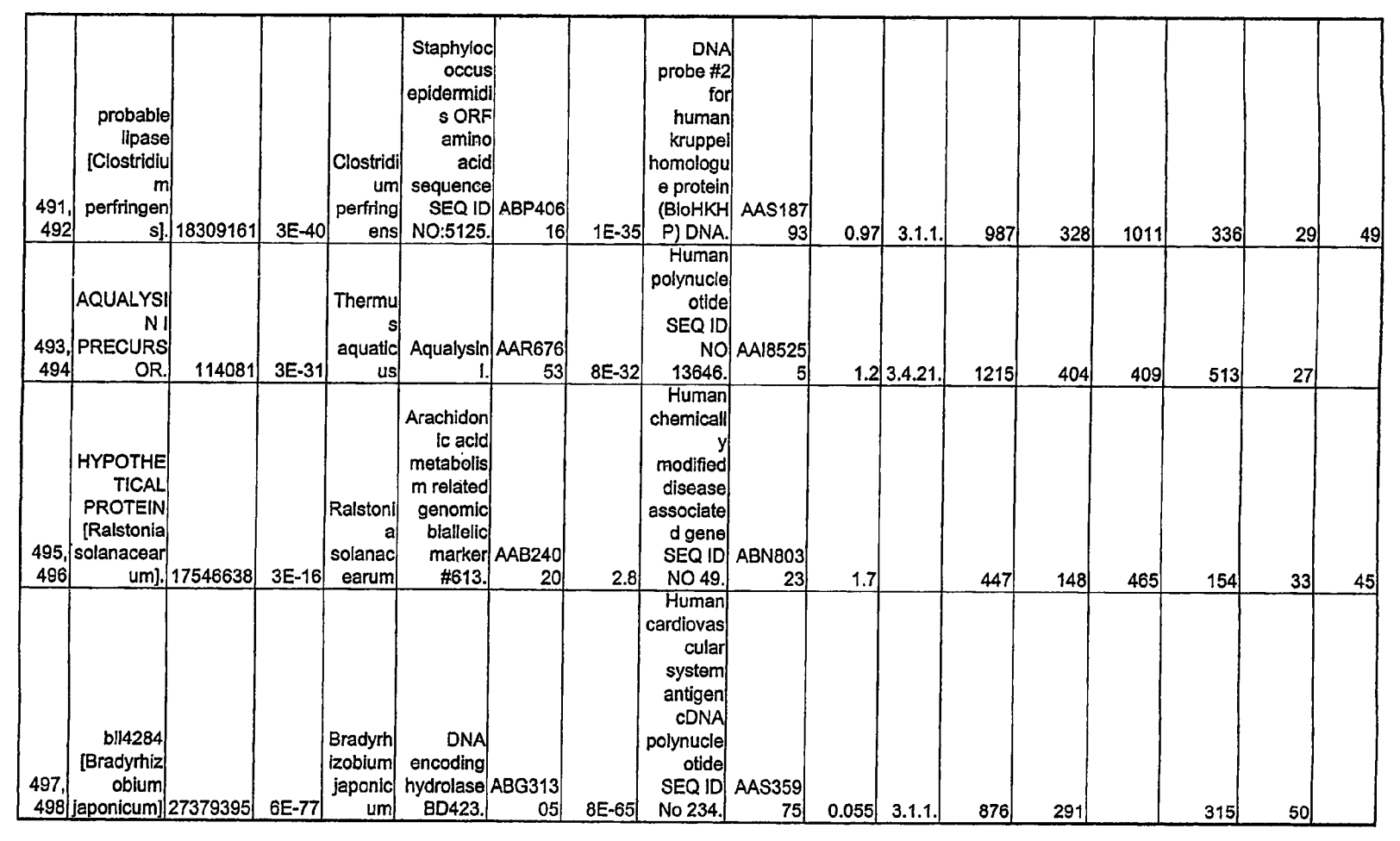

| | | | | | | | | | | |
|---|---|---|---|---|---|---|---|---|---|---|
| probable lipase [Clostridium perfringens] 491, 492 | gi\|18309161 | 3E-40 | Clostridium perfringens |

| SEQ ID NOs | Name | GI | E-value | Hit 1 Organism | Hit 1 Description | Hit 1 Acc | Score | E-value 2 | Hit 2 Organism | Hit 2 Description | Hit 2 Acc | Score | EC | | | | | | |
|---|---|---|---|---|---|---|---|---|---|---|---|---|---|---|---|---|---|---|---|
| 499, 500 | hypothetical protein [Pseudomonas fluorescens] | gi:23063375 | 0 | Pseudomonas fluorescens | Pseudomonas fluorescens lipase. | AAW27 247 | 0 | Pseudomonas fluorescens | Pseudomonas fluorescens lipase. | AAT853 97 | 1E-163 | | | 1689 | 562 | 1689 | 562 | 99 | 97 |
| 501, 502 | hypothetical protein [Pseudomonas fluorescens] | gi:23063371 | 0 | Pseudomonas fluorescens | Leishmania chagasi K39 antigen. | AAW03 691 | 3.1 | | Lung small cell carcinoma antigen, cDNA #259. | AAS618 64 | 0.1 | | | 1650 | 549 | 1653 | 550 | 70 | 72 |
| 503, 504 | hypothetical protein [Chloroflexus aurantiacus] | gi:22971392 | 4E-14 | Chloroflexus aurantiacus | Monoglyceride lipase gene probe. | AAR387 94 | 9E-13 | | Human reproductive system related antigen DNA SEQ ID NO: 8114. | AAL068 28 | 0.86 | 3.1.1.1 | | 885 | 294 | 786 | 261 | 19 | 37 |
| 505, 506 | bll2798 [Bradyrhizobium japonicum] | gi:27377909 | 4E-66 | Bradyrhizobium japonicum | Sorangium cellulosum protein Orf 15. | AAY585 81 | 2E-50 | | Arabidopsis thaliana protein fragment SEQ ID NO: 76191. | AAC546 74 | 1.2 | 3.5.2.6 | | 1254 | 417 | 1254 | 424 | 39 | |
| 507, 508 | hypothetical protein [Pseudomonas fluorescens] | gi:23063374 | 0 | Pseudomonas fluorescens | Pseudomonas fluorescens lipase. | AAW27 247 | 0 | Pseudomonas fluorescens | Pseudomonas fluorescens lipase. | AAT853 97 | 0 | 3.2.1. | | 1854 | 617 | 1854 | 617 | 93 | 89 |

FIGURE 30WW

| | | | | | | | | | | |
|---|---|---|---|---|---|---|---|---|---|---|
| 509, 510 | hypothetical protein [Pseudomonas fluorescens] 23063374 | 0 | Pseudomonas fluorescens lipase. | Pseudomonas fluorescens AAW27247 | 0 | Pseudomonas fluorescens lipase. AAT85397 | 0 | 3.4.24.40 | 1854 | 1854 | 617 | 96 | 94 |
| 511, 512 | bll4284 [Bradyrhizobium japonicum] 27379395 | 8E-51 | Bradyrhizobium japonicum DNA encoding hydrolase BD423. | ABG31304 | 6E-39 | Aspergillus onyzae polynucleotide SEQ ID NO 3150. | ABZ52547 | 0.067 | 3.1.1. | 1065 | 354 | 315 | 35 |
| 513, 514 | diaminopimelate epimerase [Nostoc sp. PCC 7120] 17232333 | 1E-41 | Herbicidally active polypeptide SEQ ID NO 2. | ABB92651 | 5E-30 | Human immunodeficiency virus (HIV) p18 peptide. | AAD25519 | 0.014 | 5.1.1.7 | 900 | 299 | 285 | 35 |
| 515, 516 | carboxylesterase family protein [Caulobacter crescentus] 16126537 | 3E-47 | Herbicidally active polypeptide SEQ ID NO 2. | ABB91130 | 3E-20 | Human polynucleotide SEQ ID NO 76. | ABL91750 | 0.21 | 3.1.1.1 | 870 | 289 | 289 | 37 | 53 |
| 517, 518 | putative xylanase [Bacteroides thetaiotaomicron VPI-5482] 29346497 | 7E-64 | Bacteroides thetaiotaomicron Cephalosporin C acetylesterase gene probe EST22. | AAR28440 | 2E-33 | Bovine EST associated with lactation/muscle/fat deposition #5642. | ABX47972 | 3.6 | | 930 | 309 | 515 | 45 |

FIGURE 30XX

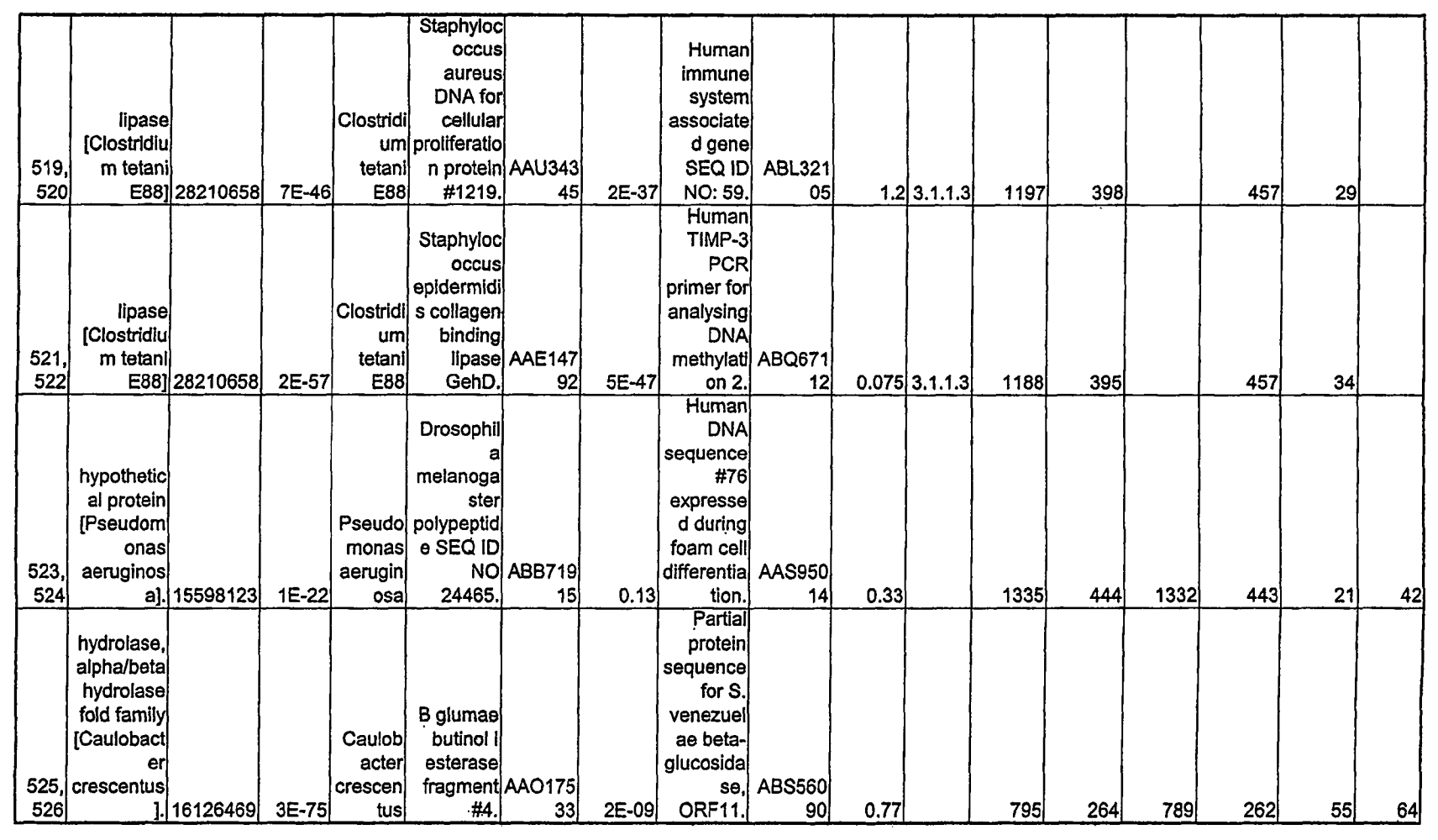

| | | | | | | | | | |
|---|---|---|---|---|---|---|---|---|---|
| 519, 520 | lipase [Clostridium tetani E88] | 28210658 | 7E-46 | Staphylococcus aureus cellular DNA for proliferation protein #1219. | AAU343

| | | | | | | | | | |
|---|---|---|---|---|---|---|---|---|---|
| 527, 528 | ORF2 [Pseudomonas aeruginosal] | 483464 | 2E-27 | Pseudomonas aeruginosa | Pseudomonas sp. SD705 (FERM BP-4772) lipase. | AAR999 75 | 2E-29 | Arabidopsis thaliana stress regulated gene SEQ ID NO 1888. | ABZ122 64 | 0.069 | 1095 | 364 | 6449 | 335 | 25 |
| 529, 530 | conserved hypothetical protein [Treponema pallidum] | 156400017 | 1E-45 | Treponema pallidum | N. gonorrhoeae nucleotide sequence SEQ ID 4691. | ABP810 39 | 9E-24 | E. coli detection primer CD-415. | AAH437 19 | 0.9 3.4.21. | 918 | 305 | 936 | 311 | 36 | 49 |
| 531, 532 | conserved hypothetical protein [Caulobacter crescentus] | 16125814 | 1E-104 | Caulobacter crescentus | Sorangium cellulosum protein Orf 15. | AAY585 81 | 5E-53 | Human gene regulation associated oligonucleotide #357. | AAS611 84 | 0.021 3.5.2.6 | 1308 | 435 | 1473 | 490 | 47 | 60 |
| 533, 534 | hypothetical protein [Novosphingobium aromaticivorans] | 231107133 | 2E-87 | Novosphingobium aromaticivorans | Listeria monocytogenes protein #849. | ABB484 16 | 2E-39 | Mycobacterium tuberculosis strain H37Rv genome SEQ ID NO 2. | AAI9968 3 | 0.004 3.1.. | 948 | 315 | 957 | 318 | 53 | 59 |

FIGURE 30ZZ

| | | | | | | | | | | |
|---|---|---|---|---|---|---|---|---|---|---|
| 535, 536 | esterase [Xylella fastidiosa 9a5c] | 15838344 | 1E-129 | Xylella fastidiosa 9a5c | DNA encoding hydrolase BD423. | ABG313 01 | 3E-32 | Human liver antigen HLDAK38 cDNA, SEQ ID NO:46. | ABN904 09 | 0.25 | 3.1... | 1026 | 341 | 1056 | 351 | 65 | 66 |
| 537, 538 | hypothetical protein [Burkholderia fungorum] | 22989184 | 1E-52 | Burkholderia fungorum | DNA encoding hydrolase BD423. | ABG313 01 | 1E-42 | Human transporter and ion channel-27 (TRICH-27) protein. | AAD272 79 | 0.89 | 3.1... | 912 | 303 | 957 | 318 | 35 | 54 |
| 539, 540 | bll5807 [Bradyrhizobium japonicum] | 27380918 | 4E-60 | Bradyrhizobium japonicum | polypeptide SEQ ID NO 24465. | ABB652 93 | 4E-06 | Mycobacterium tuberculosis strain H37Rv genome SEQ ID NO 2. | AAI9968 3 | 0.24 | | 975 | 324 | | 333 | 45 | |
| 541, 542 | lysophospholipase [Pyrococcus furiosus DSM 3638] | 18976852 | 1E-105 | Pyrococcus furiosus DSM 3638 | 5' PCR primer used to amplify S. solfataricus P1-8LC esterase gene. | ABU569 26 | 7E-85 | Putative P. abyssi phenylalanyl-tRNA synthetase alpha subunit. | AAH412 27 | 0.002 | 3.1.4.3 9 | 579 | 192 | 774 | 257 | 100 | 99 |

FIGURE 30AAA

| | | | | | | | | | | |
|---|---|---|---|---|---|---|---|---|---|---|
| lysophospholipase holipase homolog - rice. | 7489494 | 1E-22 | DNA encoding Pyrodictium TAG11-17LC. Oryza sativa | ABG759 01 | 1E-159 | DNA encoding Pyrodictium TAG11-17LC. | ABX115 03 | 0 | 3.1.4.3 9 | 837 | 278 | 894 | 297 | 100 | |
| 543, 544 | | | | | | | | | | | | | | | |
| hypothetical protein [Chloroflexus aurantiacus] | 22972687 | 3E-47 | Chlamydia trachomatis SPG6 gene encoding serine protease Chloroflexus aurantiacus | AAC6779 ABG330 8.1. 52 | 0.0005 | Bifidobacterium longum NCC2705 ORF amino acid sequence SEQ ID NO:408. | ABQ818 44 | 0.92 | | 942 | 313 | 816 | 271 | 38 | 47 |
| 545, 546 | | | | | | | | | | | | | | | |
| Homoserine O-acetyltransferase [Bacillus cereus ATCC 14579] | 30022803 | 8E-60 | Bacillus cereus ATCC 14579 L. meyeri metX DNA amplifying primer P2. | AAB480 06 | 4E-50 | Mycobacterium tuberculosis strain H37Rv genome SEQ ID NO 2. | AAI9968 3 | 0.3 | 2.3.1.3 1 | 1194 | 397 | | 374 | 35 | |
| 547, 548 | | | | | | | | | | | | | | | |
| bll7545 [Bradyrhizobium japonicum] | 27382656 | 2E-43 | B glumae butinol I esterase fragment #4. Bradyrhizobium japonicum | AAO175 33 | 3E-33 | Sequence encoding DNA endonuclease I-PorII. | AAQ443 65 | 0.24 | 3... | 954 | 317 | | 327 | 33 | |
| 549, 550 | | | | | | | | | | | | | | | |

FIGURE 30BBB

| | | | | | | | | | |
|---|---|---|---|---|---|---|---|---|---|
| 551, 552 | hypothetical protein [Photorhabdus luminescens subsp. laumondii TTO1] emb|CAE1 4606.1| unnamed protein product [Photorhabdus luminescens subsp. laumondii TTO1] | 37526221 | 0 | Serratia marcescens subsp. laumondii DNA. | AAW55 964 | Pseudomonas fluorescens lipase protein. | AAZ2227 04 | 0.007 | 1851 | 616 | 617 | 63 | |
| 553, 554 | lipO [Mycobacterium tuberculosis H37Rv] | 15608564 | 7E-65 | Mycobacterium Herbicidally active polypeptide SEQ ID NO 2 | ABB911 30 | Drosophila melanoga

| | | | | | | | | | | | | |
|---|---|---|---|---|---|---|---|---|---|---|---|---|
| 557, 558 | 23063375 | hypothetical protein [Pseudomonas fluorescens] | 2E-16 | 0 | Pseudomonas fluorescens lipase. | AAW27247 | Pseudomonas fluorescens lipase. | AAT853 97 | 1E-146 | | | | 89 |
| | 42520422 | patatin family protein [Wolbachia endosymbiont of Drosophila melanogaster] gb|AAS14271.1| patatin family protein [Wolbachia endosymbiont of Drosophila melanogaster] | | | | | | | | 1689 | 562 | 1689 | 562 | 92 |
| 559, 560 | | | | Wolbachia Pentacleth ra endosymbi macroloba ont of partial Drosop lipid acyl hila hydrolase melano (LAH) gaster cDNA. | AAE023 94 | | AAK674 26 | 6E-08 | Human immune/h aematopo ietic antigen genomic sequence SEQ ID NO:4143 | 0.21 | 870 | 289 | 302 |

FIGURE 30DDD

| | | | | | | | | | | | | | | | | | |
|---|---|---|---|---|---|---|---|---|---|---|---|---|---|---|---|---|---|
| 561, 562 | hypothetical protein [Deinococcus radiodurans]. | 15805180 | 0.33 | Deinococcus radiodurans | Babesia microti antigenic epitope fusion protein peptide BMN C term 1. | ABB88995 | 0.5 | Human chemically modified disease associated gene SEQ ID NO 49. | ABN80137 | 1.8 | | 471 | 156 | 1794 | 597 | 24 | 46 |
| 563, 564 | lipase [Pseudomonas sp. UB48]. | 9963801 | 0 | Pseudomonas sp. UB48 | Pseudomonas fluorescens lipase. | AAW27247 | 0 | Mutant lipase coding sequence. | AAX27845 | 0 | 3.4.24.40 | 1854 | 617 | 1854 | 617 | 88 | 83 |
| 565, 566 | hypothetical protein [Rhodobacter sphaeroides]. | 22956448 | 3E-44 | Rhodobacter sphaeroides | B glumae butinol I esterase fragment #4. | AAO17533 | 7E-28 | Drosophila melanogaster polypeptide SEQ ID NO 24465. | ABL03267 | 0.95 | 3... | 969 | 322 | 660 | 219 | 31 | 40 |

FIGURE 30EEE

| | | | | | | | | | |
|---|---|---|---|---|---|---|---|---|---|
| COG0596: Predicted hydrolases or acyltransferases (alpha/beta hydrolase superfamily) [Pseudomonas aeruginosa UCBPP-PA14] 567, 568 | 32038021 | 6E-57 | Pseudomonas aeruginosa UCBPP PA14 | ABB091 81 | 5E-57 | Pseudomonas aeruginosa esterase (estA) encoding DNA SEQ ID NO:3. | ABL515 87 | 0.06 | 3.7.1. | 951 | 316 | 948 | 315 | 37 | 46 |
| hypothetical protein [Chloroflexus aurantiacus] 569, 570 | 22972887 | 1E-48 | Chloroflexus aurantia cus | ABG330 52 | 0.0005 | PCR primer used to amplify bleomycin (BLM) gene cluster ORF15. | AAA584 71 | 0.061 | | 972 | 323 | 816 | 271 | 37 | |
| probable lipase/esterase [Pirellula sp.] 571, 572 | 32472501 | 9E-26 | Pirellula sp. | ABP656 59 | 2E-09 | N. gonorrhoeae aminop acid nucleotide sequence SEQ ID NO:408, 4691. | ABZ403 22 | 4.1 | | 1059 | 352 | | 373 | 25 | |

FIGURE 30FFF

| | | | | | | | | | | | |
|---|---|---|---|---|---|---|---|---|---|---|---|
| 573, 574 | hypothetical protein [Chloroflexus aurantiacus] sj:229727755 | 8E-58 | Chloroflexus aurantiacus | Bacillus subtilis serine protease SP1 (YUXL). AAW97789 | 1E-54 | Prostate cancer related gene sequence SEQ ID NO:8120. ABL68560 | 0.47 | 3.4.21. | 1887 | 628 | 2070 | 689 | 30 | 50 |
| 575, 576 | Beta-lactamase [Rhodopseudomonas palustris] emb\|CAE27589.1\| Beta-lactamase [Rhodopseudomonas palustris] CGA009] 39935217 | 3E-70 | Rhodopseudomonas palustris | Sorangium cellulosum protein Orf 15. AAY58581 | 1E-48 | Drosophila melanogaster polypeptide SEQ ID NO 24465. ABL18114 | 0.32 | 3.5.2.6 | 1293 | 430 | | 422 | 32 | |
| 577, 578 | lipase [Pseudomonas sp. UB48]. 9963801 | 4E-69 | Pseudomonas sp. UB48 | Pseudomonas fluorescens lipase. AAW27247 | 3E-69 | Cap independent translational enhancer (CITE), reverse PCR primer. ABK50870 | 0.03 | 3.4.24.40 | 1860 | 619 | 6442 | 617 | 31 | |

FIGURE 30GGG

| | | | | | | | | | |
|---|---|---|---|---|---|---|---|---|---|
| 579, 580 | hypothetical protein BB2385 [Bordetella bronchisep tica] | 33601366 | 1E-51 | Bordetella bronchisep tica | A heat-resistant maltose phosphory lase. | AAW83 021 | 1.7 | | | |
| 581, 582 | unknown [Zymomon as mobilis] gb\|AAL361 15.1\|unknown [Zymomon as mobilis] | 27356634 | 8E-63 | Zymomon as mobilis | Herbicidall y active polypeptid e SEQ ID NO 2. | AAB911 30 | 7E-15 | 0.096 | | 1524 | 507 | | 586 | 30 |
| 583, 584 | esterase [Thermoto ga maritima]. | 15643780 | 1E-104 | Thermo toga maritim a | Staphyloc occus epidermidi s ORF amino acid sequence SEQ ID NO:5125. | ABP407 99 | 5E-24 | | | | | | |
| | | | | | Human SGP003 partial phosphat ase polypepti de encoding DNA fragment. | AAD095 01 | | | | | | | |
| | | | | | Bacillus licheniform is genomic sequence tag (GST) #933. | ABK771 66 | | 3.8 | 3.1... | 984 | 327 | | 361 | 22 |
| | | | | | Methanoc occus jannaschii circular chromoso me. | AAV212 09 | | 0.19 | 3.1.1.1 | 756 | 251 | 762 | 253 | 72 |
| 585, 586 | hypothetical protein MG00837. 4 [Magnapor the grisea 70-15] | 38102326 | 0.001 | Magnap orthe grisea 70-15 | Putative P. abyssi phenylala nyl-tRNA synthetas e alpha subunit. | AAB966 69 | 0.39 | | | | | | | |
| | | | | | M. tuberculo sis and M. leprae marker protein #76. | ABX091 41 | | 0.92 | | 945 | 314 | | 625 | 11 | 66 |

FIGURE 30HHH

| | | | | | | | | | | |
|---|---|---|---|---|---|---|---|---|---|---|
| 587, 588 | hypothetical protein [Streptomyces violaceoruber] | 32455715 | 0.012 | Streptomyces violaceoruber AviX12. | ABP76680 | 0.002 | Pseudomonas fluorescens lipase protein. | AAZ22704 | 1E-150 | | | | 2773 | 19938 | 12 | 51 |
| 589, 590 | hypothetical protein [Desulfitobacterium hafniense] | 23111973 | 7E-76 | Psychrobacter immobilis lipase amino acid sequence. | AAB49668 | 5E-16 | Human chemically pretreated gene sequence #82 strand 1. | ABK39929 | 0.87 | 894 | 297 | 330 | 330 | 46 |
| 591, 592 | probable lipase/esterase [Pirellula sp.] | 32472501 | 8E-34 | DNA enncoding an esterase protein. | AAY01820 | 2E-14 | PCR primer used to amplify bleomycin (BLM) gene cluster ORF15. | AAA58472 | 0.24 | 981 | 326 | | 373 | 30 |
| 593, 594 | triacylglycerol lipase [Bacillus sp. TP10A.1]. | 7532786 | 0 | Bacillus sp. TP10A.1 SEQ ID NO:5125. | ABP39209 | 3E-61 | Human cancer related polynucleotide SEQ ID NO:4149. | ABN60127 | 4.8 3.1.1.3 | 1236 | 411 | 1257 | 418 | 98 | 97 |

FIGURE 30III

| | | | | | | | | | |
|---|---|---|---|---|---|---|---|---|---|
| 595, 596 | probable lipase/esterase [Pirellula sp.] | 324725016 | 6E-26 | Pirellula sp. | Bifidobacterium longum NCC2705 ORF amino acid sequence SEQ ID NO:408. | ABP65659 | 6E-09 | DNA encoding novel human diagnostic protein #20574. | AAS90306 | 1.7 | | 1704 | 567 | | 373 | 17 |
| 597, 598 | putative hydrolase [Streptomyces avermitilis MA-4680] | 29832211 | 3E-31 | Streptomyces avermitilis MA-4680 | Hydroxyindol-related protein. | AAG64664 | 5E-17 | Drosophila melanogaster essential gene fragment, SEQ ID NO:79. | AAH29675 | 0.2 | 3.7.1. | 813 | 270 | | 249 | 31 |
| 599, 600 | lipase [Pseudomonas sp. KB700A] | 15553087 | 0 | Pseudomonas sp. KB700A | Pseudomonas fluorescens lipase protein. | AAY55925 | 0 | Candida cylindracea lipase gene. | AAT10419 | 0 | | 1425 | 474 | 1425 | 474 | 86 | 84 |
| 601, 602 | hypothetical protein [Chloroflexus aurantiacus] | 22972687 | 1E-59 | Chloroflexus aurantiacus | Propionibacterium acnes immunogenic protein #28612. | AAU62184 | 4E-15 | Prostate cancer-associated DNA sequence #94. | ABK92242 | 0.24 | | 951 | 316 | 816 | 271 | 39 | 47 |

FIGURE 30JJJ

| | | | | | | | | | |
|---|---|---|---|---|---|---|---|---|---|
| conserved hypothetical protein [Xanthomonas axonopodis pv. citri str. 306] | 21241524 | 1E-157 | Xanthomonas axonopodis pv. citri str. 306 | Xanthomonas sp. cholesterol esterase protein SEQ ID NO:1. | AAB998 95 | 1E-170 | Xanthomonas sp. cholesterol esterase protein SEQ ID NO:1. | AAH442 84 | 1E-35 | | 1575 | 524 | 1581 | 526 | 58 |
| 603, 604 | | | | | | | | | | | | | | | |
| probable lipase/esterase [Pirellula sp.] | 32477543 | 2E-29 | Pirellula sp. | Propionibacterium acnes immunogenic protein #28612. | AAU621 84 | 2E-12 | cDNA encoding novel human musculoskeletal system antigen #2390. | ABX601 48 | 0.23 | | 921 | 306 | | 388 | 30 |
| 605, 606 | | | | | | | | | | | | | | | |
| phosphatidate cytidylyltransferase [Staphylococcus aureus subsp. aureus Mu50] | 15924251 | 2E-30 | Staphylococcus aureus subsp. aureus Mu50 | Staphylococcus aureus DNA for cellular proliferation protein #1219. | AAU352 42 | 2E-30 | Herpes simplex virus glycoprotein E. | AAQ462 40 | 0.76 | 2.7.7.4 1 | 777 | 258 | 783 | 260 | 33 | 46 |
| 607, 608 | | | | | | | | | | | | | | | |
| hypothetical protein [Novosphingobium aromaticivorans] | 23110047 | 1E-63 | Novosphingobium aromaticivorans | Bifidobacterium longum NCC2705 ORF amino acid sequence SEQ ID NO:408. | ABP656 59 | 7E-09 | Human lung tumour protein encoding cDNA #439. | ABK163 39 | 0.94 | | 963 | 320 | 981 | 326 | 43 | 56 |
| 609, 610 | | | | | | | | | | | | | | | |

| | | | | | | | | | | | |
|---|---|---|---|---|---|---|---|---|---|---|---|
| 611, 612 | esterase [Acinetobacter lwoffii] 21070428 | 1E-137 | Acinetobacter lwoffii sequence. | Esterase amino acid sequence. AAB357 39 | 1E-122 | Esterase amino acid sequence AAC662 79 | 0:001 | 3.1.1.1 | 1071 | 356 | 1098 | 365 | 64 | 63 |
| | hypothetical protein FG10020. 1 [Gibberella zeae PH-1] 42544838 | 2E-22 | Gibberella zeae PH-1 fragment. | Burkholderia cepacia 6.0 kb genomic AAB735 42 | 5E-12 | Cadherin-like asymmetry protein (CLASP). ABK850 03 | 3.2 | 3.1.1.3 | 834 | 277 | 351 | 29 | |
| 613, 614 | phospholipase A1 [Xanthomonas campestris pv. campestris str. ATCC 33913] 21232153 | 1E-100 | Xanthomonas campestris pv. campestris str. ATCC 33913 | Serratia sp heat resistant phospholipase A1 mutant AAO148 56 | 4E-42 | DNA encoding novel human diagnostic protein #20574. AAS673 45 | 0.3 | | 1197 | 398 | 1197 | 398 | 48 | 63 |
| 615, 616 | Chain A, The Crystal Structure Of The Thermophilic Carboxylesterase Est2 From Alicyclobacillus acidocaldarius. 11513478 | 1E-177 | Alicyclobacillus acidocaldarius BD423 | DNA encoding hydrolase ABG313 05 | 0 | DNA encoding hydrolase ABK899 60 | 0 | 3.1. | 933 | 310 | 933 | 310 | 99 | |
| 617, 618 | | | | | | | | | | | | | | |

| | | | | | | | | | |
|---|---|---|---|---|---|---|---|---|---|
| 619, 620 | 16519782 | 1E-69 | Y4lI [Rhizobium sp. NGR234] | DNA encoding novel human diagnostic protein #20574. | ABG079 33 | 0.045 | M, capsulatus gene #766 for DNA array. | ABQ914 18 | 0.43 | | 1710 | 569 | 2112 | 703 | 34 | 54 |
| 621, 622 | 23107741 | 1E-109 | hypothetical protein [Novosphingobium aromaticivorans] | Thermococcus 9N2-31B/G um glycosidase gene coding region. | AAW49 863 | 1E-56 | Drosophila melanogaster polypeptide of SEQ ID NO 24465. | ABL205 57 | 0.32 | 3.2.1.2 1 | 1293 | 430 | 1320 | 439 | 47 | 58 |
| 623, 624 | 16126537 | 5E-73 | carboxylesterase family protein [Caulobacter crescentus] | Herbicidally active polypeptide of SEQ ID NO 2. | ABB911 30 | 4E-16 | Rat sequence differentially expressed in response to a hepatotoxin #1056. | ABK636 86 | 0.064 | 3.1.. | 1017 | 338 | 870 | 289 | 43 | 52 |
| 625, 626 | 30020127 | 3E-78 | hypothetical Membrane Spanning Protein [Bacillus cereus ATCC 14579] | Mycobacterium tuberculosis protein | ABJ047

| | | | | | | | | | | | | | | | | | | |
|---|---|---|---|---|---|---|---|---|---|---|---|---|---|---|---|---|---|---|
| 627, 628 | phospholipase C (EC 3.1.4.3) precursor - Bacillus cereus. | 2126777 | 2E-50 | Bacillus cereus | Listeria monocytogenes protein #849. | ABB47676 | 2E-34 | Human secretory polynucleotide SPTM SEQ ID NO 534. | ABZ35958 | 0.36 | 3.1.4.3 | 1434 | 477 | | 592 | 31 | |
| 629, 630 | lipase [Clostridium tetani E88] | 28210658 | 2E-70 | Clostridium tetani E88 | Staphylococcus aureus DNA for cellular proliferation protein #1219. | AAU34345 | 7E-42 | Drosophila melanogaster polypeptide SEQ ID NO 24465. | ABL15013 | 1.3 | 3.1.1.3 | 1281 | 426 | | 457 | 42 | |
| 631, 632 | acyl-CoA thioesterase [Leptospira Interrogans serovar lai str. 56601]. | 24215261 | 1E-47 | Leptospira interrogans serovar lai str. 56601 | DNA encoding hydrolase BD423. | ABG31302 | 5E-31 | Voltage sensor motif of voltage-gated potassium channels. | AAZ36410 | 2.4 | 3.1.2. | 633 | 210 | 633 | 210 | 44 | 50 |
| 633, 634 | hypothetical protein [Pseudomonas fluorescens]. | 23062481 | 5E-46 | Pseudomonas fluorescens | S.longisporoflavus staurosporin synthesis gene cluster 1.8kb fragment. | AAW17977 | 7E-15 | Partial human non-receptor tyrosine phosphatase. | AAV03112 | 0.71 | 2.1.1. | 732 | 243 | 813 | 270 | 41 | 53 |

FIGURE 30NNN

| | | | | | | | | | | |
|---|---|---|---|---|---|---|---|---|---|---|
| 635, 636 | hypothetical protein, [Aquifex aeolicus]. | 15606577 | 1E-76 | Aquifex aeolicus | 5' PCR primer used to amplify S. solfataricus P1-8LG esterase gene. | ABU569 27 | 8E-73 | Novel human protein SEQ ID NO: 888. | ABN597 44 | 0.046 | 3.4.21. | 747 | 248 | 780 | 259 | 53 | 57 |
| 637, 638 | lactonizing lipase | 28897955 | 6E-97 | | Pseudomonas mendocina SD702 lipase primer. | AAR850 77 | 2E-93 | | AAQ945 72 | | | | | | | | |
| 639, 640 | hypothetical protein [Pseudomonas aeruginosa]. | 15598123 | 4E-22 | Pseudomonas aeruginosa | Oligonucleotide N98-23-1/2. | AAB822 14 | 0.4 | ZNF127 zinc finger motif. | ABX758 50 | 1.4 | 3.1.1.3 | 915 | 304 | | 309 | 58 | 45 |
| 641, 642 | hypothetical protein [Pseudomonas fluorescens]. | 23061978 | 0 | Pseudomonas fluorescens | Pseudomonas fragi lipase. | AAR474 85 | 0 | Pseudomonas fragi lipase. | AAQ546 96 | 0 | | 1422 | 473 | 1332 | 443 | 23 | |
| | | | | | | | | | | | | 1932 | 643 | 1911 | 636 | 58 | 62 |
| 643, 644 | bioH protein [Shewanella oneidensis MR-1]. | 24376099 | 0.007 | Shewanella oneidensis MR-1 | Serratia marcescens Sr41 esterase DNA. | AAW55 964 | 0.04 | Rhizobium species plasmid pNGR234a. | AAV304 58 | 0.54 | | 558 | 185 | 693 | 230 | 12 | 43 |

FIGURE 30000

| | | | | | | | | | | |
|---|---|---|---|---|---|---|---|---|---|---|
| hypothetical protein Rv0183 [Mycobacterium tuberculosis H37Rv] | 15607324 | 3E-34 | Propionibacterium acnes immunogenic protein #28612. | AAU553 41 | 2E-39 | N. gonorrhoeae nucleotide sequence SEQ ID 4691. | ABZ420 14 | 0.8 | 3.1.4.3 9 | 825 | 274 | 954 | 316 | 36 |
| 645, 646 | | | Mycobacterium tuberculosis H37Rv | | | | | | | | | | | |
| putative carboxylesterase [Streptomyces avermitilis MA-4680] | 298269674 | 1E-103 | Streptomyces avermitilis polyurethane esterase. | AAW81 459 | 1E-95 | Drosophila melanogaster polypeptide SEQ ID NO 24465. | ABL157 83 | | | 1566 | 521 | | 620 | 45 |
| 647, 648 | | | | | | | | | | | | | | |
| lipase [Clostridium tetani E88] | 28210658 | 9E-73 | Staphylococcus aureus DNA for cellular proliferation protein #1219. | AAU343 45 | 2E-38 | PCR primer #2 for S. atroolivaceus leinamycin gene cluster ORF-4. | ABX342 89 | 0.005 | 3.1.1.1 | 1272 | 423 | | 457 | 42 |
| 649, 650 | | | | | | | | | | | | | | |
| xylanase [Xanthomonas campestris pv. campestris str. ATCC 33913] | 21232468 | 8E-51 | Xanthomonas campestris pv. campestris acetylesterase gene probe EST22. | AAR284 40 | 6E-20 | G protein-coupled receptor (GPCR) antigenic peptide SEQ ID NO:1565. | ABZ427 60 | 3.4 | 3.1.1.3 | 879 | 292 | 1020 | 339 | 41 |
| 651, 652 | | | | | | | | | | | | | | 51 |

FIGURE 30 PPP

| | | | | | | | | | | | | | | |
|---|---|---|---|---|---|---|---|---|---|---|---|---|---|---|
| conserved hypothetical protein [Porphyromonas gingivalis W83] 653, 654 | 34540662 | 2E-42 | Porphyromonas gingivalis W83 | ABU56927 | 5' PCR primer used to amplify S. solfataricus P1-8LC esterase gene. | 2E-35 | AAZ44981 | P. alcaligenes repeat (PAR) element DNA #46. | 3.1 3.4.21. | 807 | 268 | | 263 | 38 |
| Chain A, The Crystal Structure Of The Thermophilic Carboxylesterase Est2 From Alicyclobacillus Acidocaldarius 655, 656 | 11513478 | 6E-76 | Alicyclobacillus acidocaldarius | ABG31305 | DNA encoding hydrolase BD423. | 9E-78 | AAF71251 | Corynebacterium glutamicum HA protein sequence SEQ ID NO:436. | 1E-06 | 3.1... | 927 | 308 | 1020 | 310 | 50 |
| hemolysin [Vibrio harveyi] 657, 658 | 10998525 | 0 | Vibrio harveyi | AAO17580 | M catarrhalis MCA1007 12 gene SEQ ID NO:17. | 6E-11 | ABL02501 | Drosophila melanogaster polypeptide SEQ ID NO 24465. | 1.3 | | 1239 | 412 | 1257 | 418 | 99 |

FIGURE 30QQQ

| | | | | | | | | | | |
|---|---|---|---|---|---|---|---|---|---|---|
| 659, 660 | Lactonizing lipase [Leptospira interrogans serovar lai str. 56601], 24213287 | 1E-21 | Leptospira interrogans serovar lai str. 56601 | Mature Pseudomonas pseudoalcaligenes lipase S155R variant, AAR88011 | 2E-11 | M. capsulatus gene #766 for DNA array, ABQ90984 | 0.91 | 3.1.1.3 | 933 | 310 | 921 | 306 | 30 | 42 |
| 661, 662 | lipase [Geobacillus thermoleovorans], 4835874 | 0 | Geobacillus thermoleovorans | S. epidermidis genomic polynucleotide sequence SEQ ID NO:4137, AAG82502 | 3E-63 | Aspergillus fumigatus essential gene protein #821, ABT20706 | 4.9 | 3.1.1.3 | 1251 | 416 | 1251 | 416 | 99 | 99 |
| 663, 664 | hypothetical protein; protein id: At1g61630.1, supported by cDNA: gi_16518988 [Arabidopsis thaliana], 22330367 | 3.1 | Arabidopsis thaliana | Herbicidally active polypeptide SEQ ID NO 2, ABB91423 | 0.96 | Drosophila melanogaster polypeptide SEQ ID NO 24465, ABL19013 | 7.3 | | | 489 | 2880 | 382 | 20 | |

| | | | | | | | | | | |
|---|---|---|---|---|---|---|---|---|---|---|
| 665, 666 | Predicted hydrolases or acyltransferases, alpha/beta hydrolase superfamily [Leptospira interrogans serovar lai str. 56601] | 24214735 | 5E-41 | Leptospira interrogans serovar lai str. 56601 | Herbicidally active polypeptide SEQ ID NO 2. | ABB915 79 | 8E-20 | Arabidopsis thaliana protein fragment SEQ ID NO: 76191. | AAC493 06 | 0.005 | 3.1.1.1 3 | 1155 | 384 | 1239 | 412 | 28 | 43 |
| 667, 668 | phospholipase C (EC 3.1.4.3) precursor - Bacillus cereus. | 2126777

| | | | | | | | | | | | |
|---|---|---|---|---|---|---|---|---|---|---|---|
| 673, 674 | 463L [Chilo iridescent virus]. | 15079174 | 1E-166 | Chilo iridescent virus | 5' PCR primer used to amplify S. solfataricus P1-8LC esterase gene. | ABU569 27 | 2E-11 | Human immune system associated gene SEQ ID NO: 59. | ABL340 82 | 0.014 | | | 873 | 290 | 873 | 290 | 100 | 100 |
| 675, 676 | hypothetical protein [Novosphingobium aromaticivorans]. | 23110047 | 2E-43 | Novosphingobium aromaticivorans | Cephalosporin C acetylesterase gene probe EST22. | AAR284 40 | 5E-07 | Prostate cancer related gene sequence SEQ ID NO:8120. | ABL686 23 | 3.7 | 948 | 315 | 981 | 326 | 35 | 46 |
| 677, 678 | hypothetical protein [Novosphingobium aromaticivorans]. | 23110047 | 1E-42 | Novosphingobium aromaticivorans | Bifidobacterium longum NCC2705 ORF amino acid sequence SEQ ID NO:408. | ABP656 59 | 4E-06 | DNA encoding novel human diagnostic protein #20574. | AAS939 09 | 0.7 | 717 | 238 | 981 | 326 | 44 | 59 |

FIGURE 30TTT

| | | | | | | | | | | |
|---|---|---|---|---|---|---|---|---|---|---|
| predicted Phospholip ase/Carbo xylesteras e [Leptospira interrogan s serovar lai str. 56601] | | | | | | | | | | |
| 679, 680 | 24216184 | 8E-42 | Leptospira interrog ans serovar Chlamydia lai str. trachomati 56601 s. | PCR primer used to amplify an ORF of | AAY370 64

| | | | | | | | | | | | | | | | |
|---|---|---|---|---|---|---|---|---|---|---|---|---|---|---|---|
| 687, 688 | carboxylesterase [Bacillus halodurans] | 15615369 | 2E-63 | 5' PCR primer used to amplify S. solfataricus P1-8LC esterase gene. | ABU56929 | 4E-37 | Aspergillus fumigatus essential gene protein #821. | ABT21098 | 3.4 | 3.1.1.1 | 885 | 294 | 966 | 321 | 42 | 49 |
| 689, 690 | lipase LipA [Streptomyces cinnamoneus] | 2435400 | 5E-27 | Propionibacterium acnes immunogenic protein #28612. | AAU47738 | 2E-23 | Oligonucleotide for detecting cytosine methylation on SEQ ID NO 20311. | ABQ34157 | 0.047 | 3.1.1.3 | 762 | 253 | 828 | 275 | 35 | 58 |
| 691, 692 | hypothetical protein FG10020.1 [Gibberella zeae PH-1] | 42544838 | 2E-07 | Gibberella zeae PH-1 ORF amino acid sequence SEQ ID NO:5125. | ABP38026 | 0.027 | Human immune/haematopoietic antigen genomic sequence SEQ ID NO:4143. | AAK83286 | 0.049 | | 789 | 262 | | 351 | 23 | |
| 693, 694 | hypothetical protein [Pseudomonas aeruginosa] | 15597511 | 2E-83 | Ester hydrolase. | AAW94999 | 6E-80 | Human transmembrane CO126 protein SEQ ID NO:2. | ABQ81832 | 4.5 | 3.5.2.6 | 1152 | 383 | 1176 | 391 | 45 | 55 |

FIGURE 30VVV

| | | | | | | | | | |
|---|---|---|---|---|---|---|---|---|---|
| hypothetical protein [Burkholderia fungorum] | 229983573 | 4E-46 | Burkholderia fungorum | DNA encoding hydrolase BD423. | ABG31302 | 1E-119 | DNA encoding hydrolase BD423. | ABK89957 | | | | | | 27 | |
| 695, 696 | | | | | | | | | | | | | | | |
| probable transmembrane protein [Chromobacterium violaceum ATCC 12472] | 34499829 | 5E-39 | Chromobacterium violaceum ATCC 12472 | N. violaceum nucleotide sequence SEQ ID 4691. | ABP81039 | 9E-33 | Oligonucleotide for detecting cytosine methylation SEQ ID NO 20311. | ABQ17449 | 0 | 3.1.2. | 642 | 213 | 642 | 213 | 35 |
| 697, 698 | | | | | | | | | | | | | | | |
| hypothetical protein [Novosphingobium aromaticivorans] | 231110047 | 3E-36 | Bifidobacterium longum NCC2705 ORF amino acid sequence SEQ ID NO:408. | | ABP65659 | 2E-10 | Ramoplanin biosynthetic ORF 20 protein. | AAL40781 | 0.052 | 3.4.21. | 828 | 275 | | 299 | |
| 699, 700 | | | | | | | | | | | 0.061 | 969 | 322 | 981 | 326 | 33 |
| hypothetical protein [Pseudomonas fluorescens] | 23062851 | 0.0005 | Pseudomonas fluorescens | Arabidopsis thaliana protein fragment SEQ ID NO. 76191. | AAG45212 | 1.6 | AB005287 cDNA clone. | AAC90070 | 1.4 | | 1446 | 481 | 1428 | 475 | 18 | 43 |
| 701, 702 | | | | | | | | | | | | | | | |

FIGURE 30WWW

| | | | | | | | | | | | | | |
|---|---|---|---|---|---|---|---|---|---|---|---|---|---|
| hypothetical protein [Ralstonia metallidurans] 703, 704 | gi\|22980221 | 1E-105 | Ralstonia metallidurans | PCR primer used to amplify ORF122 of Neisseria species. | AAY387 78 | 2E-31 | | | | | | | 52 |
| hypothetical protein [Pseudomonas syringae pv. syringae B728a] 705, 706 | gi\|23470769 | 4E-55 | Pseudomonas syringae pv. syringae B728a | Herbicidally active polypeptide SEQ ID NO 2. | ABB911 30 | | Drosophila melanogaster polypeptide of SEQ ID NO 24465. | ABL207 70 | 0.45 | 3.4.21. | 1800 | 599 | 2370 | 789 | 40 | 51 |
| triacylglycerol lipase [Triticum aestivum] 707, 708 | gi\|21425571 | 0.0001 | Triticum aestivum | Rice neutral triacylglycerol lipase cDNA. | AAY323 17 | 7E-20 | Human cDNA differentially expressed in granulocytic cells #55. | ABK847 98 | 0.054 | 3.1... | 870 | 289 | 903 | 300 | 40 | |
| lipase, putative [Deinococcus radiodurans] 709, 710 | gi\|15807072 | 5E-21 | Deinococcus radiodurans | Archaeoglobus venificus esterase SNP6-24LC. | AAW23 087 | 5E-58 | Human testicular antigen encoding cDNA SEQ ID NO: 746. | ABL973 89 | 0.71 | | 726 | 241 | 517 | 126 | 14 | |
| hypothetical protein [Pseudomonas fluorescens] 711, 712 | gi\|23063375 | 0 | Pseudomonas fluorescens | Pseudomonas fluorescens lipase. | AAW27 247 | 0 | Aspergillus fumigatus essential gene protein #821. | ABT194 61 | 2.4 | 3.1.1.3 | 636 | 211 | 4277 | 210 | | |
| | | | | | AAT853 97 | 1E-160 | Pseudomonas fluorescens lipase. | | | | 1689 | 562 | 1689 | 562 | 92 | 90 |

FIGURE 30XXX

| | | | | | | | | | | |
|---|---|---|---|---|---|---|---|---|---|---|
| 713, 714 | lysophospholipase [Pyrococcus furiosus DSM 3638], 18976852 | 1E-122 | Pyrococcus solfataricus DSM 3638 | 5' PCR primer used to amplify S. solfataricus P1-8LC esterase gene. ABU569 26 | 1E-119 | 5' PCR primer used to amplify S. solfataricus P1-8LC esterase gene. ABX767 41 | 2E-07 | 3.1.4.3 9 | 771 | 256 | 774 | 257 | 81 | 72 |
| 715, 716 | unknown protein [Gloeobacter violaceus] dbj\|BAC89950.1\| gll2009 [Gloeobacter violaceus PCC 7421] 37521578 | 0.16 | Gloeobacter violaceus | Human cytokine receptor protein, sbg45654 8CytoRa #3. AAE173 16 | 0.062 | Drosophila melanogaster polypeptide SEQ ID NO 24465. ABL142 58 | 2.3 | | 603 | 200 | 11439 | 452 | 25 | |
| 717, 718 | hypothetical protein [Magnetospirillum magnetotacticum], 23016000 | 9E-46 | Magnetospirillum magnetotacticum | DNA encoding hydrolase BD423. ABG313 02 | 4E-30 | Cephalosporin antibiotic biosynthetic enzyme AAQ101 #9. 90 | 0.045 | 3.1.2. | 717 | 238 | 699 | 232 | 42 | 55 |

FIGURE 30YYY

| | | | | | | | | | | | | | | | | | |
|---|---|---|---|---|---|---|---|---|---|---|---|---|---|---|---|---|---|
| 719, 720 | conserved hypothetical protein [Xanthomonas campestris pv. campestris str. ATCC 33913]. | 21230175 | 1E-161 | Xanthomonas campestris pv. campestris str. ATCC 33913 | Xanthomonas sp. cholesterol esterase protein SEQ ID NO:1. | AAB99895 | 1E-173 | Xanthomonas sp. cholesterol esterase protein SEQ ID NO:1. | AAH44284 | 3E-39 | | 1575 | 524 | 1581 | 526 | 59 | |
| 721, 722 | conserved hypothetical protein [Wolinella succinogenes] | 34557803 | 2E-34 | Wolinella succinogenes | 5' PCR primer used to amplify S. solfataricus P1-8LC esterase gene. | ABU56927 | 1E-26 | Human immune/haematopoietic antigen genomic sequence SEQ ID NO:41436. | AAK82338 | 0.19 | 3.4.21. | 765 | 254 | | 285 | 33 | |
| 723, 724 | bll4189 [Bradyrhizobium japonicum] | 27379300 | 2E-67 | Bradyrhizobium japonicum | DNA encoding hydrolase BD423. | ABG31305 | 1E-58 | DNA encoding hydrolase BD423. | ABK89962 | 0.001 | 3.1.. | 936 | 311 | | 325 | 47 | |
| 725, 726 | probable thermolabile hemolysin [Chromobacterium violaceum ATCC 12472] | 34495815 | 1E-138 | Chromobacterium violaceum ATCC 12472 | Herbicidally active polypeptide SEQ ID NO 2. | ABB91173 | 7E-13 | Human novel polynucleotide #432. | ABX05211 | 4.9 | | 1263 | 420 | | 417 | 57 | |

FIGURE 30ZZZ

| SEQ IDs | GI | E-value | Organism | Description | Accession | E-value | Description 2 | Accession 2 | Val | EC | | | | | | |
|---|---|---|---|---|---|---|---|---|---|---|---|---|---|---|---|---|
| 727, 728 | 15899257 | 2E-64 | Lipase (lipP-2) [Sulfolobus solfataricus] | Sulfolobus solfataricus DNA encoding hydrolase | ABG313 04 | 2E-63 | Human secretory polynucleotide SPTM SEQ ID NO 534. | ABZ360 46 | 0.93 | 3.1.1. | 948 | 315 | 936 | 311 | 40 | 52 |
| 729, 730 | 30262592 | 6E-68 | lipase; putative [Bacillus anthracis str. Ames] | S. epidermidis genomic polynucleotide sequence SEQ ID NO:4137. | AAG825 02 | 1E-41 | Human polynucleotide SEQ ID NO 702. | ABL906 68 | 0.085 | 3.1.1.3 | 1350 | 449 | | 400 | 38 | 96 |
| 731, 732 | 23063374 | 0 | hypothetical protein [Pseudomonas fluorescens] | Pseudomonas fluorescens | AAW27 247 | 0 | Pseudomonas fluorescens lipase. | AAT853 97 | 0 | 3.4.24. 40 | 1854 | 617 | 1854 | 617 | 97 | 61 |
| 733, 734 | 15600990 | 1E-106 | lactonizing lipase [Vibrio cholerae] | PCR primer used in the course of the invention. | AAW53 925 | 1E-104 | Pseudomonas sp. strain SD705 lipase variant primer IN1. | AAZ093 44 | 0.015 | 3.1.1.3 | 933 | 310 | 1020 | 339 | 61 | |
| 735, 736 | 15553087 | 0 | lipase [Pseudomonas sp. KB700A] | Pseudomonas sp. fluorescens lipase [Pseudomonas sp. KB700A] protein. | AAY559 25 | 0 | Candida cylindracea lipase gene. | AAT104 19 | 0 | | 1425 | 474 | 1425 | 474 | 86 | 84 |

FIGURE 30AAAA

| | | | | | | | | | | |
|---|---|---|---|---|---|---|---|---|---|---|
| hypothetical protein [Thermobifida fusca] | 23017746 | 7E-60 | Thermobifida fusca | Lactococcus lactis protein ps123. ABB54054 | 1E-24 | Mycobacterium tuberculosis strain H37Rv genome SEQ ID NO 2. AAI99683 | 0.053 | | 852 | 283 | 831 | 276 | 47 | 59 |
| 737, 738 | | | | | | | | | | | | | | |
| esterase [Thermotoga maritima] | 15643780 | 3E-99 | Thermotoga maritima | Monoglyceride lipase gene AAR38749 probe. | 1E-23 | Aspergillus fumigatus essential gene protein #821. ABT19839 | 2.9 | 3.1.1.1 | 759 | 252 | 762 | 253 | 68 | 62 |
| 739, 740 | | | | | | | | | | | | | | |
| probable lipase/esterase [Pirellula sp.] | 32472501 | 2E-38 | Pirellula sp. | Bacterial esterase protein #25. AAW93498 | 4E-16 | Orthosomycin biosynthetic polypeptide of SEQ ID NO 273. ABZ66809 | 3.9 | 3.1... | 1014 | 337 | | 373 | 32 | |
| 741, 742 | | | | | | | | | | | | | | |
| hypothetical protein [Nostoc punctiforme] | 23126501 | 3E-55 | Nostoc punctiforme | Herbicidally active polypeptide of SEQ ID NO 2. ABB93401 | 9E-26 | Human polypeptide of SEQ ID NO 1595. ABZ11481 | 0.22 | 3.1.4.4 6 | 900 | 299 | 999 | 332 | 41 | 45 |
| 743, 744 | | | | | | | | | | | | | | |
| carboxylesterase [Oceanobacillus iheyensis] | 23099884 | 5E-93 | Oceanobacillus iheyensis | DNA encoding hydrolase BD42303. ABG31303 | 2E-89 | DNA encoding hydrolase BD42358. ABK89958 | 1E-17 | 3.1.1.1 | 747 | 248 | 741 | 246 | 62 | 67 |
| 745, 746 | | | | | | | | | | | | | | |

FIGURE 30BBBB

| | | | | | | | | | | | | | | | |
|---|---|---|---|---|---|---|---|---|---|---|---|---|---|---|---|
| 747, 748 | putative lipase/este rase [Rhodopse udomonas palustris] emb\|CAE2 7866.1] putative lipase/este rase [Rhodopse udomonas palustris] | CGA009 | 39935491 | 2E-72 | Rhodop seudom onas palustri s | DNA encoding hydrolase | ABG313 05 | 1E-56 | Mitochon drially-targeted aequorin gene reverse PCR primer. | ABA914 10 | 0.015 | 3.1.. | 942 | 313 | 314 | 42 |
| 749, 750 | possible polysacch aride deacetylas e [Rhodopse udomonas palustris] emb\|CAE2 8606.1] possible polysacch aride deacetylas e [Rhodopse udomonas palustris] | CGA009 | 39936228 | 1E-47 | Rhodop seudom onas palustri s | S. pneumoni ae type 4 strain protein from coding region #1864. | ABU019 28 | 7E-19 | Drosophil a melanoga ster polypepti de SEQ ID NO 24465. | ABL203 19 | 0.2 | 3.5.1. | 804 | 267 | 457 | 27 |

FIGURE 30CCCC

| SEQ ID | Description | Source | Hit 1 | Acc 1 | E-value | Hit 2 | Acc 2 | E-value 2 | col | col | col | col | col | col |
|---|---|---|---|---|---|---|---|---|---|---|---|---|---|---|
| 751, 752 | hypothetical protein [Pseudomonas fluorescens] | 23062920 | 0 | Alkaline protease. | AAR205 40 | 1E-154 | Reverse primer to prepare a vector with protease gene. | ABL416 83 | 1E-111 | 3.4.24. | 1407 | 468 | 1803 | 600 | 90 | 90 |
| 753, 754 | hypothetical protein [Novosphingobium aromaticivorans] | 23110052 | 1E-111 | An aminopolyol amine oxidase for expression in Pichia. | AAY688 51 | 2E-66 | lip1 primer D. | AAH436 25 | 0.1 | 3.1.1.1 | 1623 | 540 | 1509 | 502 | 43 | 50 |
| 755, 756 | hypothetical protein [Archaeoglobus fulgidus] | 11498734 | 1E-156 | Murine TANGO 273 cDNA. | AAB660 86 | 7E-06 | DNA encoding novel human diagnostic protein #20574. | AAS789 83 | 1.3 | | 1365 | 454 | 1371 | 456 | 60 | 60 |
| 757, 758 | hypothetical protein [Streptomyces avermitilis MA-4680] | 29833151 | 6E-33 | New DNA sequence isolated from Pinctada fucata. | AAW56 163 | 0.12 | Oligonucleotide for detecting cytosine methylation SEQ ID NO 20311. | ABQ207 83 | 1.2 | | 1257 | 418 | | 453 | 30 | |
| 759, 760 | probable lipase/esterase [Pirellula sp.] | 324472501 | 5E-43 | Herbicidally active polypeptide SEQ ID NO 2. | ABB911 30 | 1E-16 | Oligonucleotide for detecting cytosine methylation SEQ ID NO 20311. | ABQ488 67 | 0.86 | | 885 | 294 | | 373 | 35 | |

FIGURE 30DDDD

| | | | | | | | | | | |
|---|---|---|---|---|---|---|---|---|---|---|
| 761, 762 | conserved hypothetical protein [Vibrio vulnificus YJ016] dbj\|BAC97295.1\| | 37676929 | Vibrio vulnificus YJ016 | 6E-34 | Archaeoglobus venificus esterase SNP6-24LC. | AAW23078 | 1E-112 | Archaeoglobus venificus esterase SNP6-24LC. | AAT79331 | 0 | 606 | 201 | 605 | 201 | 100 |
| 763, 764 | hypothetical protein Daro3341 01 [Dechloromonas aromatica RCB] | 41723082 | Dechloromonas aromatica RCB | 0.018 | Archaeoglobus venificus esterase SNP6-24LC. | AAW23078 | 0.12 | Drosophila melanogaster polypeptide de SEQ ID NO 24465, | ABL16940 | 0.4 | 1599 | 532 | 1269 | 294 | 12 |
| 765, 766 | Diaminopimelate decarboxylase [Leptospira interrogans serovar lai str. 56601] | 24213747 | Leptospira interrogans serovar lai str. 56601 | 1E-114 | PCR primer #2 for S. atroolivaceus leinamycin gene cluster ORF 4. | ABU11360 | 1E-101 | Dihydrodipicolinate reductase (dapA) DNA cloning primer. | ABQ79582 | 4.1.1.2 0.31 | 1260 | 419 | 422 | 49 | 53 |

FIGURE 30EEEE

| | | | | | | | | | | | | | | | | |
|---|---|---|---|---|---|---|---|---|---|---|---|---|---|---|---|---|
| 767, 768 | conserved hypothetical protein [Chlorobium tepidum TLS]. | 21674697 | 1E-17 | Chlorobium tepidum TLS | Archaeoglobus venificus esterase SNP6-24LC. | AAW23079 | 8E-38 | Human cDNA #466 differentially expressed in activated vascular tissue. | ABX63842 | 0.72 3.4.21. | 744 | 247 | 3172 | 259 | 35 | |
| 769, 770 | extracellular lipase [Pseudomonas fluorescens]. | 4115630 | 0 | Pseudomonas fluorescens | Pseudomonas fluorescens lipase protein. | AAY55925 | 0 | Pseudomonas fluorescens lipase protein. | AAZ22704 | 0 | 1431 | 476 | 1431 | 476 | 98 | 91 |
| 771, 772 | conserved hypothetical protein [Porphyromonas gingivalis W83] | 34541487 | 2E-96 | Porphyromonas gingivalis W83 | Mycobacterium tuberculosis protein 10. | ABJ04710 | 4E-13 | Human enzyme protein encoding gene. | AAD48290 | 4 3.4.21. | 1038 | 345 | | 339 | 52 | |
| 773, 774 | bll4001 [Bradyrhizobium japonicum] | 27379112 | 5E-96 | Bradyrhizobium japonicum | Fumonisin catabolising gene cluster isolation related oligonucleotide. | AAY80085 | 3E-78 | Drosophila melanogaster polypeptide SEQ ID NO 24465. | ABL01943 | 0.099 3.1.1.1 | 1569 | 522 | | 516 | 40 | |

FIGURE 30FFFF

| | | | | | | | | | | |
|---|---|---|---|---|---|---|---|---|---|---|
| 775, 776 | hypothetical protein [Ralstonia metallidurans] 22975888 | 0.51 | Ralstonia metallidurans | DNA encoding novel human diagnostic protein #20574. ABG19506 | 1.7 | Streptomyces viridochromogenes AviX12. ABZ1375 37 | 1.7 | | 450 | 149 | 2070 | 689 | 25 | 52 |
| 777, 778 | AQUALYSIN I PRECURSOR. 114081 | 5E-32 | Thermus aquaticus | Aqualysin AAR67653 | 1E-32 | Human PDE4D gene microsatellite marker related primer #62. ABX08336 | | | | | | | 28 | |
| 779, 780 | lipase; putative [Bacillus anthracis str. Ames] 30262592 | 0 | Bacillus anthracis str. Ames | Staphyloccus epidermidis collagen binding lipase GehD. AAE14792 | 5E-69 | Human metastasis associated gene SEQ ID NO: 93. ABL34628 | 4.3 3.4.21. | 1116 | 371 | 513 | | | | |
| | | | | | | | 0.078 3.1.1.3 | 1242 | 413 | | 400 | 90 | |
| 781, 782 | Beta-lactamase [Rhodopseudomonas palustris] emb|CAE27589.1| Beta-lactamase [Rhodopseudomonas palustris] CGA009 39935217 | 4E-71 | Rhodopseudomonas palustris | Sorangium cellulosum Orf 15. AAY58581 | 2E-51 | Sorangium cellulosum Orf 15. AAZ55887 | 1E-06 3.5.2.6 | 1290 | 429 | 422 | | 32 | | |

FIGURE 30GGGG

| | | | | | | | | |
|---|---|---|---|---|---|---|---|---|
| 783, 784 | LIPASE PRECURS OR (TRIACYL GLYCERO L LIPASE), 1170792 | 0 | Pseudo monas fluoresc ens | Pseudom onas fluorescen s lipase protein. AAY559 25 | 0 | Candida cylindrac ea lipase gene. AAT104 19 | | | 1431 | 476 | 476 | 96 |
| 785, 786 | Chain A, The Crystal Structure Of The Thermophi lic Carboxyle sterase Est2 From Alicycloba cillus acidocalda rius, 11513478 | 1E-78 | Alicyclo bacillus acidoca Idarius | DNA encoding hydrolase BD423. ABG313 05 | 5E-80 | Archaeog lobus veniflcus esterase SNP6-24LC. AAT793 36 | 4E-06 | 3.1.. | 936 | 311 | 914 | 310 | 50 |
| 787, 788 | lipase, putative [Deinococ cus radiodura ns], 158070072 | 2E-22 | Deinoc occus radiodu rans | Archaeogl obus veniflcus esterase SNP6-24LC. AAW23 087 | 2E-58 | Archaeog lobus veniflcus esterase SNP6-24LC. AAT793 40 | 0.01 | 3.1.1.3 | 642 | 213 | 661 | 210 | 51 |
| 789, 790 | lipase [Clostridiu m tetani E88] 28210658 | 2E-47 | Clostridi um tetani E88 | Arabidops is thaliana protein fragment SEQ ID NO: 76191. AAG149 12 | 4E-48 | Staphyloc occus aureus DNA for cellular proliferati on protein #1219. AAS524 01 | 0.28 | 3.1.1.3 | 1134 | 377 | 687 | 467 | 31 |

FIGURE 30HHHH

| | | | | | | | | | | |
|---|---|---|---|---|---|---|---|---|---|---|
| hydrolase; alpha/beta fold family [Pseudomonas putida KT2440] | 791, 792 | 26991224 | 2E-61 | Pseudomonas putida KT2440 polypeptide. | AAW30 522 | 4E-24 | Kurthia sp. bioH/l gene-encoded polypeptide, SEQ ID NO:2287. | ABQ557 64 | 0.78 | 3.1.1.2 4 | 801 | 266 | | 270 | 43 | |
| putative carboxymethylenebutenolidase [Yersinia pestis KIM] | 793, 794 | 22124358 | 1E-08 | Escherichia coli polypeptide SEQ ID NO 730. | ABB530 61 | 0.0001 | Streptococcus agalactiae PCR primer SEQ ID NO 11875. | ABN673 80 | 0.19 | | 780 | 259 | 873 | 290 | 23 | 64 |
| hypothetical protein [Novosphingobium aromaticivorans] | 795, 796 | 23107133 | 3E-97 | Listeria monocytogenes protein #849. | ABB484 16 | 2E-44 | CMV IE gene primer AAT355 2.1. | 22 | 0.004 | 3.1.1.1 4 | 948 | 315 | 957 | 318 | 56 | |
| esterase [uncultured bacterium]. | 797, 798 | 9454064 | 3E-62 | Pseudomonas aeruginosa esterase (estA) encoding DNA SEQ ID NO:3. | ABB091 86 | 7E-55 | Mycobacterium tuberculosis strain H37Rv genome SEQ ID NO.2 | AAI9968 3 | 2E-11 | 3.1.1.2 4 | 900 | 299 | 1317 | 438 | 46 | 59 |

FIGURE 30IIII

| | | | | | | | | | | | |
|---|---|---|---|---|---|---|---|---|---|---|---|
| 799, 800 | putative WD-repeat containing protein [Amycolatopsis orientalis]. | 5051805 | 1E-49 | Amycolatopsis orientalis | Drosophila melanogaster polypeptide SEQ ID NO: 24465. | ABB585 42 | 0.0002 | Drosophila melanogaster polypeptide de SEQ ID NO 24465. | ABL233 16 | 1.2 | | 1245 | 414 | 3726 | 1241 | 40 | 47 |
| 801, 802 | COG0596: Predicted hydrolases or acyltransferases (alpha/beta hydrolase superfamily) [Pseudomonas aeruginosa UCBPP-PA14] | 32038021 | 2E-68 | Pseudomonas aeruginosa UCBPP-PA14 | Pseudomonas aeruginosa esterase (estA) encoding DNA SEQ ID NO:3. | ABB091 81 | 2E-68 | Signal transduction associated gene modified complementary entary DNA #131. | ABK312 43 | 3.7 | 3.7.1.1 | 960 | 319 | | 315 | 42 | |
| 803, 804 | carboxylesterase [Pseudomonas putida KT2440] | 26987863 | 0 | Pseudomonas putida KT2440 | Authentic ester hydrolase gene. | AAR106 76 | 1E-165 | Human ORFX protein sequence SEQ ID NO:1971 | ABN211 14 | 9E-54 | | 1146 | 381 | | 381 | 96 | |

FIGURE 30JJJJ

| | | | | | | | | | | | | | |
|---|---|---|---|---|---|---|---|---|---|---|---|---|---|
| hypothetical protein [Aquifex aeolicus]. | 15606577 | 5E-35 | Aquifexs aeolicus | 5' PCR primer used to amplify S. solfataricu s P1-8LC esterase gene. | ABU589 27 | 6E-33 | Polypeptide-Ras GTP enzyme activator protein 14 related peptide. | ABL562 65 | 0.76 | 3.4.21. | 777 | 258 | 780 | 259 | 34 | 46 |
| 805, 806 | | | | | | | | | | | | | | | | |
| hypothetical protein [Novosphingobium aromaticivorans]. | 23110047 | 3E-47 | Novosphingobium aromaticivorans | Cephalosporin C acetylesterase gene probe EST22. | AAR284 40 | 1E-08 | Mycobacterium tuberculosis strain H37Rv genome SEQ ID NO 2. | AAI9968 3 | 0.0009 | | 873 | 290 | 981 | 326 | 39 | 56 |
| 807, 808 | | | | | | | | | | | | | | | | |
| lipase [Pseudomonas sp. KB700A]. | 15553087 | 0 | Pseudomonas sp. fluorescens KB700 A | Pseudomonas sp. fluorescens lipase protein. | AAY559 25 | 0 | Candida cylindracea lipase gene. | AAT104 19 | 0 | | 1425 | 474 | 1425 | 474 | 86 | 84 |
| 809, 810 | | | | | | | | | | | | | | | | |
| esterase [Oceanobacillus iheyensis]. | 230097755 | 4E-95 | Oceanobacillus iheyensis | Monoglyceride lipase gene probe. | AAR387 94 | 6E-86 | Human cDNA differentially expressed in granulocytic cells #55. | ABK842 98 | 0.73 | 3.1.1.1 | 750 | 249 | 741 | 246 | 65 | 64 |
| 811, 812 | | | | | | | | | | | | | | | | |

FIGURE 30KKKK

| | | | | | | | | | | |
|---|---|---|---|---|---|---|---|---|---|---|
| 813, 814 | conserved hypothetical protein [Nitrosomonas europaea ATCC 19718] | 30249661 | 8E-22 | Thermus DNA encoding a Nitrosomonas europaea thermostable esterase, ATCC TspA/E10 19718 | AAU018 1. | 52 | 3E-39 | Rat A013 two hybrid PCR primer 9. | ABL587 66 | 1.1 | | 1116 | 371 | 3696 | 329 | 29 | |
| 815, 816 | hypothetical protein [Ferroplasma acidarmanus] | 22406010 | 2E-64 | Ferroplasma acidarmanus DNA encoding hydrolase BD423. | ABG313 04 | 2E-58 | Drosophila melanogaster polypeptide of SEQ ID NO 24465. | ABL117 41 | 0.83 | 3.1.1.1 | 849 | 282 | 927 | 308 | 45 | 53 |
| 817, 818 | hypothetical protein Daro3341 01 [Dechloromonas aromatica RCB] | 41723082 | 0.35 | Dechloromonas aromatica RCB DNA SEQ ID No 198. | ABJ189 52 | 0.8 | Platenolide synthase gene cluster. | AAT804 14 | 0.41 | | 1632 | 543 | | 294 | 14 | |
| 819, 820 | hypothetical protein [Desulfitobacterium hafniense]. | 23112939 | 9E-41 | Desulfitobacterium hafniense DNA encoding hydrolase BD423. | ABG313 01 | 3E-33 | Human Immunodeficiency virus (HIV) p18 peptide. | AAD255 19 | 0.83 | 3.1... | 849 | 282 | 1254 | 417 | 34 | 48 |

FIGURE 30LLLL

| | | | | | | | | | | |
|---|---|---|---|---|---|---|---|---|---|---|
| 821, 822 | hypothetical protein [Chloroflexus aurantiacus] | 22970507 | 2E-30 | Chloroflexus aurantiacus | Putative P abyssi phenylalanyl-tRNA synthetase alpha subunit. | AAB960 55 | 7E-17 | Bovine EST associated with lactation/ muscle/fat depositio n #5642. | ABX479 67 | 2.8 | | 726 | 241 | 588 | 195 | 29 | 38 |
| 823, 824 | putative bacteriophage protein [Salmonella enterica subsp. enterica serovar Typhi]. | 16760770 | 2E-39 | Salmonella enterica subsp. enterica serovar Typhi | M. tuberculosis and M. leprae marker protein #76. | ABU054 79 | 0.034 | Yeast selected interacting domain coding sequence SEQ ID NO: 59. | ABT113 03 | 1.6 | | 426 | 141 | 453 | 150 | 58 | 64 |
| 825, 826 | conserved hypothetical protein [Porphyromonas gingivalis W83] | 34541487 | 2E-97 | Porphyromonas gingivalis W83 | Mycobacterium tuberculosis protein #16. | ABJ047 10 | 1E-13 | BAC containing repeats from centromeres 1-4 | AAF223 03 | 1 | 3.4.21. | 1038 | 345 | 882 | 339 | 52 | |
| 827, 828 | lipase [Pseudomonas fragi]. | 9971138 | 1E-84 | Pseudomonas fragi | DNA encoding Pseudomonas lipase. | AAP900 65 | 2E-79 | P. aeruginosa hydrolase gene. | AAX027 79 | 0.004 | 3.1.1.3 | 879 | 292 | 293 | 53 | 57 |

FIGURE 30MMMM

| | | | | | | | | | | | | | | | | | |
|---|---|---|---|---|---|---|---|---|---|---|---|---|---|---|---|---|---|
| 829, 830 | hypothetical protein [Burkholderia fungorum]. | 22988980 | 2E-14 | Burkholderia fungorum | Herbicidally active polypeptide SEQ ID NO 2. | ABB91861 | 3E-08 | Drosophila melanogaster polypeptide SEQ ID NO 24465. | ABL05495 | 0.046 | | 735 | 244 | 1005 | 334 | 28 | 50 |
| 831, 832 | metal protease [Pseudoalteromonas sp. A28]. | 18700311 | 1E-136 | Pseudoalteromonas sp. A28 | Aminopeptidase precursor processing enzyme PCR primer SEQ ID NO:24. | AAY87584 | 1E-125 | Aminopeptidase precursor processing enzyme PCR primer, SEQ ID NO:24. | 'AAA14051 | 4E-33 | 3.4.24. | 2430 | 809 | 2196 | 731 | 37 | 43 |
| 833, 834 | hypothetical protein [Microbulbifer degradans 2-40]. | 23029245 | 2E-16 | Microbulbifer degradans 2-40 | 4-Hydroxyphenylpyruvate oxidase mutant #3. | ABB76959 | 5E-07 | Staphylococcus aureus DNA for cellular proliferation protein #1219. | AAS54240 | 0.072 | | 1140 | 379 | 990 | 329 | 19 | 37 |
| 835, 836 | bll2798 [Bradyrhizobium japonicum] | 27377909 | 2E-62 | Bradyrhizobium japonicum | Sorangium cellulosum protein Orf 15. | AAY58581 | 3E-44 | cDNA encoding novel human musculoskeletal system antigen #2390. | ABX60583 | 4.9 | 3.5.2.6 | 1263 | 420 | | 424 | 37 | |

FIGURE 30NNNNN

| | | | | | | | | | | |
|---|---|---|---|---|---|---|---|---|---|---|
| 837, 838 | dihydrodipi colinate synthase [Rhodopse udomonas palustris] emb|CAE2 8127.1| dihydrodipi colinate synthase [Rhodopse udomonas palustris CGA009] | 39935752 | 6E-13 | Rhodop seudom onas palustri s | mos gene; 5.1 DNA fragment. | AAR045 70 | 4E-11 | mos gene; 5.1 DNA fragment. | AAQ043 03 | 0.003 | 4.2.1.5 | 2 | 210 | 69 | 297 | 47 |
| 839, 840 | acetyl esterase family enzyme [Clostridiu m acetobutyli cum]. | 15896170 | 3E-33 | Bifidobact erium longum NCC2705 ORF amino acid sequence SEQ ID NO:408. | ABP656 59 | 5E-32 | cDNA encoding novel human connectiv e tissue related polypepti de #266. | ABK424 63 | 1E-100 | 1.1 | | 1074 | 357 | 819 | 272 | 21 |
| 841, 842 | hypothetic al protein, [Pseudom onas fluorescen s]. | 23063375 | 0 | Pseudo monas fluoresc ens | Pseudom onas fluorescen s lipase. | AAW27 247 | 0 | Pseudom onas fluoresce ns lipase. | AAT853 97 | 0 | | | 1689 | 562 | 1689 | 562 | 99 | 96 |

FIGURE 300000

| | | | | | | | | | | | | | | | | | |
|---|---|---|---|---|---|---|---|---|---|---|---|---|---|---|---|---|---|
| 843, 844 | conserved hypothetical protein [Xanthomonas campestris pv. campestris str. ATCC 33913]. | 21229637 | 1E-120 | Xanthomonas campestris pv. campestris str. ATCC 33913 | PCR primer used to amplify ORF122 of Neisseria species. | AAY38778 | 8E-64 | Staphylococcus aureus DNA for cellular proliferation protein #1219. | AAS56053 | 0.26 | 3.4.21. | 1032 | 343 | 1038 | 345 | 65 | 71 |
| 845, 846 | acyl-CoA thioesterase I precursor [Bordetella parapertussis] | 33597579 | 1E-50 | Bordetella parapertussis | DNA encoding hydrolase BD423. | ABG31302 | 1E-42 | Drosophila melanogaster polypeptide SEQ ID NO 24465. | ABL17333 | 0.69 | 3.1.. | 708 | 235 | | 202 | 43 | |
| 847, 848 | polyneuridine aldehyde esterase [Rauvolfia serpentina] | 6651393 | 8E-08 | Rauvolfia serpentina | Arabidopsis thaliana protein fragment SEQ ID NO: 76191. | AAG44380 | 1E-07 | Saccharopolyspora busR butenyl-spinosyn biosynthetic gene product. | ABV75558 | 0.39 | | 408 | 135 | 795 | 264 | 30 | 46 |
| 849, 850 | carboxylesterase [Oceanobacillus iheyensis]. | 23099884 | 5E-92 | Oceanobacillus iheyensis | DNA encoding hydrolase BD423. | ABG31303 | 1E-137 | DNA encoding hydrolase BD423. | ABK89958 | 0 | 3.1.1.1 | 747 | 248 | 747 | 248 | 93 | |

FIGURE 30PPPP

| | | | | | | | | | | |
|---|---|---|---|---|---|---|---|---|---|---|
| 851, 852 | hypothetical protein [Novosphingobium aromaticivorans] | 23107133 | 2E-95 | Novosphingobium aromaticivorans | Listeria monocytogenes protein #849. | ABB484 16 | 3E-42 | Mitochondrially-targeted aequorin gene reverse PCR primer. | ABA914 10 | 0.015 | 3.1.. | 948 | 315 | 957 | 318 | 55 | 62 |
| 853, 854 | bialaphos acetylhydrolase - Streptomyces hygroscopicus. | 421649 | 7E-39 | Streptomyces hygroscopicus | Mycobacterium tuberculosis fad28 gene. | AAB664 57 | 3E-34 | Mitochondrially-targeted aequorin gene reverse PCR primer. | ABA914 10 | 0.27 | 3.1.. | 1098 | 365 | | 299 | 29 | |
| 855, 856 | probable lipase/esterase [Pirellula sp.] | 324775543 | 8E-29 | Pirellula sp. | DNA encoding hydrolase BD423. | ABG313 05 | 6E-16 | Drosophila melanogaster polypeptide de SEQ ID NO 24465. | ABL135 43 | 0.81 | 3.1.1.1. | 831 | 276 | | 388 | 32 | |

FIGURE 30QQQQ

| | | | | | | | | |
|---|---|---|---|---|---|---|---|---|
| 857, 858 | ENSANGP00000013422 [Anopheles gambiae str. PEST] | 31209243 | 2E-09 | Anopheles gambia e S194A #5 | Human beta-II tryptase active site mutant | AAU120406 | 2E-07 | Bifidobacterium longum NCC2705 ORF amino acid sequence SEQ ID NO:408. | ABQ81842 | 0.23 | | 945 | 314 | | | |
| 859, 860 | esterase [Acinetobacter lwoffii] | 21070428 | 1E-165 | Acinetobacter lwoffii | Esterase amino acid sequence. | AAB35739 | 1E-127 | | | 3E-28 | 3.1.. | 909 | 302 | 1098 | 394 | 14 |
| | | | | | | | | Esterase amino acid sequence | AAC66279 | | | | | | 365 | 93 | 81 |
| 861, 862 | hypothetical protein [Pseudomonas aeruginosa] | 15598321 | 5E-57 | Pseudomonas aeruginosa | Lipase gene #2. | AAR352 05 | 7E-57 | Lipase gene #2. | AAQ38956 | 0.019 | | 1188 | 395 | 1329 | 442 | 37 |
| 863, 864 | conserved hypothetical protein [Porphyromonas gingivalis W83] | 34541487 | 2E-96 | Porphyromonas gingivalis W83 | Mycobacterium tuberculosis protein | ABJ04710 | 2E-14 | Human NS cDNA sequence SEQ ID NO:76. | ABL39805 | | 1 3.4.21. | 1038 | 345 | | 339 | 52 | 56 |

FIGURE 30RRRR

| | | | | | | | | | | | | | | | | | |
|---|---|---|---|---|---|---|---|---|---|---|---|---|---|---|---|---|---|
| 865, 866 | Chain A, The Crystal Structure Of The Thermophilic Carboxylesterase Est2 From Alicyclobacillus Acidocaldarius. | 11513478 | 1E-78 | Alicyclobacillus acidocaldarius | DNA encoding hydrolase BD423. | ABG31305 | 5E-80 | Archaeoglobus venificus esterase SNP6-24LC. | AAT79336 | 4E-06 | 3.1.. | 936 | 311 | 914 | 310 | 50 | |
| 867, 868 | esterase [Xylella fastidiosa 9a5c]. | 15838344 | 1E-111 | Xylella fastidiosa 9a5c | Acinetobacter lwoffi RAG-1 protein sequence. | ABP52441 | 4E-26 | Isoprenoid related PCR primer SEQ ID No 53. | AAL40121 | 1.2 | 3.1.. | 1245 | 414 | 1056 | 351 | 49 | 53 |
| 869, 870 | phospholipase C (EC 3.1.4.3) precursor - Bacillus cereus. | 2126777 | 2E-48 | Bacillus cereus | Listeria monocytogenes protein #849. | ABB47676 | 1E-32 | Gene #112 used to diagnose liver cancer. | ABN96859 | 0.35 | 3.1.4.3 | 1422 | 473 | | 592 | 31 | |

FIGURE 30SSSS

| | | | | | | | | | |
|---|---|---|---|---|---|---|---|---|---|
| 871, 872 | 1-phosphatidylinositol phosphodiesterase precursor [Bacillus cereus ATCC 14579] | 30021854 | 1E-178 | Bacillus cereus ATCC 14579 genes protein #849. | ABB476 80 | 2E-16 | Murine apoptosis related DNA sequence #201. | ABL013 58 | 0.97 | 3.1.4.1 | 987 | 328 | | 329 | 89 |
| 873, 874 | bll4001 [Bradyrhizobium japonicum] | 27379112 | 1E-82 | Fumonisin catabolising gene cluster isolation related oligonucleotide. | AAY800 85 | 7E-74 | Saccharopolyspora busR butenyl-spinosyn biosynthetic gene product. | ABV755 58 | 0.41 | 3.1.1.1 | 1641 | 546 | | 516 | 36 |
| 875, 876 | Lipase (lipP-1) [Sulfolobus solfataricus] | 15899234 | 1E-160 | 5' PCR primer used to amplify S. solfataricus P1-8LC esterase gene. | ABU569 30 | 1E-173 | Archaeoglobus venificus esterase SNP6-24LC. | AAT793 30 | 0 | 3.1.1.1 | 918 | 305 | 918 | 305 | 99 |
| 877, 878 | ORF5 [Moritella marina] | 6691651 | 3E-36 | Moritella Pyrodictium TAG11-17LC. | ABG759 00 | 5E-29 | Gene #112 used to diagnose liver cancer. | ABN972 13 | 0.81 | 3.4.21. | 828 | 275 | 861 | 286 | 33 |
| | | | | | | | | | | | | | | | 48 |

FIGURE 30TTTT

| | | | | | | | | | | |
|---|---|---|---|---|---|---|---|---|---|---|
| 879, 880 | hypothetical protein [Azotobacter vinelandii] | 23102229 | 7E-71 | Azotobacter vinelandii | Acetobacter pasteurianus racemic exo-norbornyl ester dll hydrolase | AAR721 24 | 3E-71 | Drosophila melanogaster polypeptide of SEQ ID NO 24465. | ABL300 30 | 0.059 | 3.7.1. | 939 | 312 | 4963 | 388 | 44 | |
| 881, 882 | beta-hemolysin Staphylococcus aureus | 97786 | 8E-95 | Staphylococcus aureus | Staphylococcus epidermidis ORF amino acid sequence SEQ ID NO:5125. | ABP403 10 | 1E-89 | Buchnera sp. related PCR primer R SEQ ID NO:7. | ABA927 87 | 0.015 | 3.1.4.3 | 963 | 320 | | 331 | 54 | |
| 883, 884 | hypothetical protein [Novosphingobium aromaticivorans] | 23110612 | 1E-24 | Novosphingobium aromaticivorans | Archaeoglobus venificus esterase SNP6-24LC. | AAW23 083 | 2E-13 | Human cDNA #466 differentially expressed in activated vascular tissue. | ABX636 61 | 0.23 | 3.1.1.1 | 918 | 305 | 975 | 324 | 29 | 50 |
| 885, 886 | hypothetical protein (Pseudomonas fluorescens) | 23060403 | 1E-92 | Pseudomonas fluorescens | DNA encoding hydrolase BD423. | ABG313 02 | 1E-39 | P. putida KT2440-associated DNA ORF0377 4. | AAF610 82 | 3E-12 | 3.1.2. | 606 | 201 | 867 | 288 | 83 | 81 |

FIGURE 30UUUU

| | | | | | | | | | | | | | | | | | |
|---|---|---|---|---|---|---|---|---|---|---|---|---|---|---|---|---|---|
| 887, 888 | conserved protein [Methanothermobacter thermautotrophicus]. | 15679370 | 0.006 | Methanothermobacter thermautotrophicus | Putative P abyssi phenylalanyl-tRNA synthetase alpha subunit. | AAB96204 | 0.004 | Propionibacterium acnes immunogenic protein #28612. | AAS59559 | 0.71 | | 726 | 241 | 15706 | 434 | 22 | |
| 889, 890 | unknown [Acinetobacter sp ADP1]. | 19068133 | 8E-56 | Acinetobacter sp. ADP1 | Amino acid sequence of stereoselective esterase fragment 161299Afr23. | ABB09721 | 9E-34 | Sequence of forward primer HVPET63N for the synthesis of P64 of Heliothis armigera RNA 2. | AAQ58522 | 0.002 | | 1581 | 526 | 1743 | 580 | 29 | 47 |
| 891, 892 | LIPASE PRECURSOR (TRIACYLGLYCEROL LIPASE). | 13959402 | 1E-05 | Thermomyces lanuginosus | Lipolytic enzyme opt. N- or C-terminal extension peptide #55. | AAW21107 | 7E-08 | SR protein-specific kinase-1 protein, SEQ ID No 18. | AAL54213 | 0.19 | | 756 | 251 | 113033 | 269 | 21 | |

FIGURE 30VVVV

| | | | | | | | | | | |
|---|---|---|---|---|---|---|---|---|---|---|
| 893, 894 | hypothetical protein [Azotobacter vinelandii] | 23104027 | 6E-38 | Azotobacter vinelandii | PCR primer used to amplify ORF122 of Neisseria species. | AAY387 79 | 5E-09 | Arabidopsis thaliana nucleic acid sequence Ref:2027 405 SEQ ID NO:405. | ABL932 74 | 4.2 | | | | | | 51 |
| 895, 896 | hypothetical protein [Chloroflexus aurantiacus] | 22971644 | 0.003 | Chloroflexus aurantiacus | Archaeoglobus venificus esterase SNP6-24LC. | AAW23 078 | 0.15 | N. gonorrhoeae nucleotide sequence SEQ ID 4691. | ABZ400 95 | 1.5 | 1083 | 360 | 1131 | 376 | 32 |
| | | | | | | | | | | | | | | | 44 |
| 897, 898 | putative carboxylesterase [Salmonella typhimurium LT2] | 16764967 | 0 | Salmonella typhimurium LT2 | Fumonisin catabolising gene cluster isolation related oligonucleotide. | AAY800 85 | 5E-65 | Drosophila melanogaster polypeptide of SEQ ID NO 24465. | ABL199 49 | 0.095 | 3.1.1.1 | 1533 | 510 | 1581 | 527 | 11 |
| | | | | | | | | | | | | 1506 | 501 | 1509 | 502 | 74 | 70 |
| 899, 900 | bll4189 [Bradyrhizobium japonicum] | 27379300 | 7E-69 | Bradyrhizobium japonicum | DNA encoding hydrolase | ABG313 05 | 1E-59 | Mycobacterium tuberculosis strain H37Rv genome SEQ ID NO 2. | AAI9968 3 | 0.0002 | 3.1... | 936 | 311 | | 325 | 48 |

FIGURE 30WWWW

| | | | | | | | | | | | |
|---|---|---|---|---|---|---|---|---|---|---|---|
| | | | | | | | | | | 55 | |
| 901, 902 | hypothetic al protein [Burkholde ria fungorum]. | 22983383 | 4E-86

| | | | | | | | | | | | |
|---|---|---|---|---|---|---|---|---|---|---|---|
| lipase; putative [Bacillus anthracis str. Ames] | 30262592 | 1E-117 | Bacillus anthracis str. Ames | Staphylococcus aureus DNA for cellular proliferation protein #1219. | AAU34345 | 7E-76 | Staphylococcus epidermidis ORF amino acid sequence SEQ ID NO:5125. | ABN91217 | 4E-10 | 3.1.1.3 | 1260 | 419 | | 400 | 49 | |
| lipase, putative [Deinococcus radiodurans] | 15806498 | 9E-66 | Deinococcus radiodurans | DNA encoding hydrolase BD423. | ABG31305 | 3E-57 | Mitochondrially-targeted aequorin gene reverse PCR primer. | ABA91410 | 0.057 | 3.1... | 906 | 301 | 972 | 323 | 49 | 60 |
| lipase [Clostridium tetani E88] | 28211180 | 1E-20 | Clostridium tetani E88 | Bifidobacterium longum NCC2705 ORF amino acid sequence SEQ ID NO:408. | ABP65659 | 1E-10 | Human Patched-2 PCR primer RACE 5. | ABX15923 | 3.4 | | 885 | 294 | | 329 | 25 | |

FIGURE 30YYYY

| | | | | | | | | | | | |
|---|---|---|---|---|---|---|---|---|---|---|---|
| hypothetical protein [Chloroflexus aurantiacus] | 229700681 | 2E-79 | Chloroflexus aurantiacus | Acetobacter pasteurianus racemic exo-norbornyl ester hydrolase. | AAR72124 | 1E-10 | Staphylococcus aureus DNA for cellular proliferation protein #1219. | AAS54144 | 0.61 | 3.1.1.1 | 627 | 208 | 768 | 255 | 70 | 66 |
| 915, 916 | | | | | | | | | | | | | | | | |
| probable esterase [Pseudomonas putida] | 40882349 | 7E-70 | Pseudomonas putida | DNA encoding hydrolase BD423. | ABG31301 | 2E-40 | Staphylococcus aureus DNA for cellular proliferation protein #1219. | AAS52287 | 0.76 | 3.1.. | 786 | 261 | | 319 | 37 | |
| 917, 918 | | | | | | | | | | | | | | | | |
| lysophospholipase-like [Homo sapiens] | 60057865 | 0.0002 | Homo sapiens | Oligonucleotide primer, SR7, used to sequence human NOV7. | ABG76945 | 0.00007 | M. tuberculosis and M. leprae marker protein #76. | ABX09140 | 0.19 | | 762 | 253 | 82993 | 313 | 16 | |
| 919, 920 | | | | | | | | | | | | | | | | |
| conserved hypothetical protein [Porphyromonas gingivalis W83] | 34541487 | 7E-97 | Porphyromonas gingivalis W83 | Mycobacterium tuberculosis protein | ABJ04710 | 2E-13 | Human NS cDNA sequence SEQ ID NO:76. | ABL39805 | 1 | 3.4.21. | 1038 | 345 | | 339 | 53 | |
| 921, 922 | | | | | | | | | | | | | | | | |

FIGURE 30ZZZZ

| | | | | | | | | | | | |
|---|---|---|---|---|---|---|---|---|---|---|---|
| hypothetical protein [Novosphingobium aromaticivorans] | 23109921 | 2E-38 | Novosphingobium aromaticivorans | Burkholderia cepacia 6.0 kb genomic fragment. | AAB73542 | 0.002 | Cap independent translational enhancer (CITE), reverse PCR primer. | ABK50867 | 0.17 | | 684 | 227 | 810 | 269 | 39 | 56 |
| prolyl endopeptidase [Nostoc sp. PCC 7120] | 17230025 | 1E-102 | Nostoc sp. PCC 7120 | S. capsulata prolyl oligopeptidase protein. | AAW40286 | 1E-86 | Aeromonas punctata prolyl endopeptidase (PEP) DNA. | AAC64102 | 5E-08 | 3.4.21.26 | 777 | 258 | 2070 | 689 | 67 | 60 |
| hypothetical protein [Desulfitobacterium hafniense] | 23112939 | 1E-58 | Desulfitobacterium hafniense | DNA encoding hydrolase BD423. | ABG31301 | 4E-38 | Staphylococcus aureus DNA for cellular proliferation protein #1219. | AAS52378 | 0.26 | 3.1.. | 1047 | 348 | 1254 | 417 | 37 | 48 |
| putative esterase/lipase [Streptomyces coelicolor A3(2)] | 21220601 | 2E-43 or A3(2) | Streptomyces coelicolor | Monoglyceride lipase gene AAR38794 probe. | AAR38794 | 8E-32 | Mouse CAAX processing enzyme RCE1 cDNA + 5' genomic DNA. | AAV80324 | 0.2 | 3.1.1.1 | 819 | 272 | | 267 | 40 | |

FIGURE 30AAAAA

| | | | | | | | | | |
|---|---|---|---|---|---|---|---|---|---|
| 931, 932 | conserved hypothetical protein [Leptospira interrogans serovar lai str. 56601] | 24217208 | 2E-42 | Leptospira interrogans serovar lai str. 56601 | AAG532 76191. 91 | 0.34 | DNA transcription associated complementary genomic DNA | ABK281 #142. 47 | 0.62 | | 636 | 211 | 648 | 215 | 39 | 55 |
| 933, 934 | putative lipase [Bordetella parapertussis] | 33598583 | 1E-103 | Bordetella parapertussis | ABU569 26 | 7E-26 | 5' PCR primer used to amplify S. solfataricus P1-8LC esterase gene. | Carboxylic acid esterase AAQ626 44 | 3E-12 | 0.004 | 3.1.4.3 9 | 894 | 297 | | 277 | 63 | |
| 935, 936 | PUTATIVE OXIDOREDUCTASE PROTEIN [Sinorhizobium meliloti] | 15965747 | 3E-54 | Sinorhizobium meliloti | AAW30 522 | 0.0001 | Kurthia sp. bioHII gene-encoded polypeptide | Human POLD2 protein. AAD360 70 | 0.85 | 3.1.1.2 4 | 867 | 288 | 864 | 287 | 40 | 52 |
| 937, 938 | transposase [Methanosarcina acetivorans str. C2A] | 20090285 | 1E-92 | Methanosarcina acetivorans str. C2A | ABP576 98 | | Saccharopolyspora busR butenyl-spinosyn biosynthetic gene product. | ABN685 16 | 1.4 | | 1437 | 478 | 1434 | 477 | 41 | 50 |

FIGURE 30BBBBB

| | | | | | | | | | | |
|---|---|---|---|---|---|---|---|---|---|---|
| 939, 940 | lipase [Streptomyces coelicolor A3(2)]. | 4102170 | 1E-20 | Streptomyces coelicolor A3(2) | T. fusca ester group cleaving enzyme protein fragment. | AAB860 32 | 2E-16 | Human serine/threonine protein kinase-like kinase. | ABS555 00 | 0.064 | | 1017 | 338 | 933 | 310 | 21 | 43 |
| 941, 942 | hypothetical protein [Nostoc punctiforme]. | 23126850 | 5E-32 | Nostoc punctiforme | Kurthia sp. bioHlI gene-encoded polypeptide. | AAW30 522 | 6E-28 | E. coli CFT073 genomic sequence #198. | ABS790 15 | 0.2 | 3.1.1.2 4 | 792 | 263 | 813 | 270 | 30 | 46 |
| | Citrate synthase [Prochlorococcus marinus str. MIT 9313] | 33864286 | 0.095 | Prochlorococcus marinus str. MIT 9313 | Haemophilus influenzae hypothetical (PABA synthase) protein encoding DNA. | AAE304 62 | 0.77 | Protein fragment #32 of S. roseosporus biosynthetic gene cluster. | ABQ788 73 | 0.31 | | 327 | 108 | | 404 | 33 | |
| 943, 944 | esterase MesA [Pasteurella multocida] | 113385866 | 2E-36 | Pasteurella multocida | Listeria monocytogenes protein | ABB486 90 | 7E-34 | Human immune system associated gene SEQ ID NO: 59. | ABL342 42 | 2.9 | 3.2.1.4 1 | 759 | 252 | 810 | 269 | 32 | 49 |
| 945, 946 | similar to acylamino acyl-peptidase [Bacillus subtilis]. | 16080276 | 1E-175 | Bacillus subtilis | Bacillus subtilis serine protease SP1 (YUXL). | AAW97 789 | 1E-176 | Bacillus subtilis serine protease SP1 (YUXL). | AAX073 01 | 4E-11 | 3.4.21. | 2022 | 673 | 1971 | 657 | 46 | |

FIGURE 30CCCCC

| | | | | | | | | | | |
|---|---|---|---|---|---|---|---|---|---|---|
| endo-1,4-beta-xylanase Z precursor [Bacteroides thetaiotaomicron VPI-5482] | 29349485 | 4E-53 | Bacteroides thetaiotaomicron VPI-5482 | Streptococcus agalactiae PCR primer SEQ ID NO 11875. | ABP303 55 | 4E-18 | Human microtubulin 11 oligonucleotide probe #2. | AAS160 53 | 3.5 | 909 | 302 | 288 | 40 |
| 949, 950 | | | | | | | | | | | | | |
| probable lipase/esterase [Pirellula sp.] | 32477543 | 2E-59 | Pirellula sp. | Bacterial esterase protein fragment #25. | AAW93 498 | 2E-15 | Staphylococcus epidermidis ORF amino acid sequence SEQ ID NO:5125. | ABN930 19 | 0.9 | 918 | 305 | 388 | 42 |
| 951, 952 | | | | | | | | | | | | | |
| tannase precursor [Xanthomonas campestris pv. campestris str. ATCC 33913] | 21231541 | 1E-113 | Xanthomonas campestris pv. campestris str. ATCC 33913 | Penicillin V amidohydrolase promoter fragment. | AAW00 291 | 9E-61 | AH1-19 peptide. | ABK240 94 | 1.6 | 1629 | 542 | 576 | 44 |
| 953, 954 | | | | | | | | | | | | | |
| | | | | | | | | | | 1731 | | | 54 |

FIGURE 30DDDDDD

HYDROLASES, NUCLEIC ACIDS ENCODING THEM AND METHODS FOR MAKING AND USING THEM

RELATED APPLICATIONS

This application is a national phase application claiming benefit of priority under 35 U.S.C. §371 to Patent Convention Treaty (PCT) International Application Ser. No: PCT/US2004/007095, filed Mar. 08, 2004 (published as WO 2005/032496 on Apr. 14, 2005), which claims benefit of priority to U.S. Provisional patent application Ser. No. ("U.S. Ser. No.") 60/453,450, filed Mar. 07, 2003; U.S. Ser. No. 60/458,123, filed Mar. 24, 2003; and 60/513,332, filed Oct. 21, 2003. The aforementioned applications are explicitly incorporated herein by reference in their entirety and for all purposes.

REFERENCE TO SEQUENCE LISTING SUBMITTED ON A COMPACT DISK

Submission On Compact Disc

The content of the following submission on compact disc is incorporated herein by reference in its entirety: A compact disc copy of the sequence listing (COPY 1) (file name: 564462011900, date recorded: Jun. 26, 2006, size: 2,283,520 bytes); a duplicate compact disc copy of the sequence listing (COPY 2) (file name: 564462011900, date recorded: Jun. 26, 2006, size: 2,283,520 bytes); and a computer readable form copy of the sequence listing (CRF COPY) (file name: 564462011900, date recorded: Jun. 26, 2006, size: 2,283,520 bytes).

| File Name | Date of Creation | Size (bytes) |
|---|---|---|
| Sequence Listing.txt | Mar. 5, 2004 | 2,283,520 |

TECHNICAL FIELD

This invention relates to molecular and cellular biology and biochemistry. In one aspect, the invention provides hydrolases, polynucleotides encoding them, and methods of making and using these polynucleotides and polypeptides. In one aspect, the invention is directed to polypeptides, e.g., enzymes, having a hydrolase activity, e.g., an esterase, acylase, lipase, phospholipase or protease activity, including thermostable and thermotolerant hydrolase activity, and polynucleotides encoding these enzymes, and making and using these polynucleotides and polypeptides. The hydrolase activities of the polypeptides and peptides of the invention include esterase activity, lipase activity (hydrolysis of lipids), acidolysis reactions (to replace an esterified fatty acid with a free fatty acid), transesterification reactions (exchange of fatty acids between triglycerides), ester synthesis, ester interchange reactions, phospholipase activity (e.g., phospholipase A, B, C and D activity, patatin activity, lipid acyl hydrolase (LAH) activity) and protease activity (hydrolysis of peptide bonds). The polypeptides of the invention can be used in a variety of pharmaceutical, agricultural and industrial contexts, including the manufacture of cosmetics and nutraceuticals. In another aspect, the polypeptides of the invention are used to synthesize enantiomerically pure chiral products.

In one aspect, the polypeptides of the invention are used in the biocatalytic synthesis of structured lipids (lipids that contain a defined set of fatty acids distributed in a defined manner on the glycerol backbone), including cocoa butter alternatives (CBA), lipids containing poly-unsaturated fatty acids (PUFAs), diacylglycerides, e.g., 1,3-diacyl glycerides (DAGs), monoglycerides, e.g., 2-monoglycerides (MAGs) and triacylglycerides (TAGs). In one aspect, the polypeptides of the invention are used to modify oils, such as fish, animal and vegetable oils, and lipids, such as poly-unsaturated fatty acids. The hydrolases of the invention having lipase activity can modify oils by hydrolysis, alcoholysis, esterification, transesterification and/or interesterification. The methods of the invention can use lipases with defined regio-specificity or defined chemoselectivity in biocatalytic synthetic reactions.

Additionally, the polypeptides of the invention can be used in food processing, brewing, bath additives, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents, in increasing starch yield from corn wet milling and pharmaceuticals such as digestive aids and anti-inflammatory (anti-phlogistic) agents.

BACKGROUND

The major industrial applications for hydrolases, e.g., esterases, lipases, phospholipases and proteases, include the detergent industry, where they are employed to decompose fatty materials in laundry stains into easily removable hydrophilic substances; the food and beverage industry where they are used in the manufacture of cheese, the ripening and flavoring of cheese, as antistaling agents for bakery products, and in the production of margarine and other spreads with natural butter flavors; in waste systems; and in the pharmaceutical industry where they are used as digestive aids.

Oils and fats an important renewable raw material for the chemical industry. They are available in large quantities from the processing of oilseeds from plants like rice bran oil, rapeseed (canola), sunflower, olive, palm or soy. Other sources of valuable oils and fats include fish, restaurant waste, and rendered animal fats. These fats and oils are a mixture of triglycerides or lipids, i.e. fatty acids (FAs) esterified on a glycerol scaffold. Each oil or fat contains a wide variety of different lipid structures, defined by the FA content and their regiochemical distribution on the glycerol backbone. These properties of the individual lipids determine the physical properties of the pure triglyceride. Hence, the triglyceride content of a fat or oil to a large extent determines the physical, chemical and biological properties of the oil. The value of lipids increases greatly as a function of their purity. High purity can be achieved by fractional chromatography or distillation, separating the desired triglyceride from the mixed background of the fat or oil source. However, this is costly and yields are often limited by the low levels at which the triglyceride occurs naturally. In addition, the purity of the product is often compromised by the presence of many structurally and physically or chemically similar triglycerides in the oil.

An alternative to purifying triglycerides or other lipids from a natural source is to synthesize the lipids. The products of such processes are called structured lipids because they contain a defined set of fatty acids distributed in a defined manner on the glycerol backbone. The value of lipids also increases greatly by controlling the fatty acid content and distribution within the lipid. Lipases can be used to affect such control.

Phospholipases are enzymes that hydrolyze the ester bonds of phospholipids. Corresponding to their importance in the metabolism of phospholipids, these enzymes are widespread among prokaryotes and eukaryotes. The phospholipases affect the metabolism, construction and reorganization of biological membranes and are involved in signal cascades. Several types of phospholipases are known which differ in their specificity according to the position of the bond attacked in the phospholipid molecule. Phospholipase A1 (PLA1) removes the 1-position fatty acid to produce free fatty acid and 1-lyso-2-acylphospholipid. Phospholipase A2 (PLA2) removes the 2-position fatty acid to produce free fatty acid and 1-acyl-2-lysophospholipid. PLA1 and PLA2 enzymes can be intra-or extra-cellular, membrane-bound or soluble. Intracellular PLA2 is found in almost every mammalian cell. Phospholipase C (PLC) removes the phosphate moiety to produce 1,2 diacylglycerol and phospho base. Phospholipase D (PLD) produces 1,2-diacylglycerophosphate and base group. PLC and PLD are important in cell function and signaling. Patatins are another type of phospholipase thought to work as a PLA.

In general, enzymes, including hydrolases such as esterases, lipases and proteases, are active over a narrow range of environmental conditions (temperature, pH, etc.), and many are highly specific for particular substrates. The narrow range of activity for a given enzyme limits its applicability and creates a need for a selection of enzymes that (a) have similar activities but are active under different conditions or (b) have different substrates. For instance, an enzyme capable of catalyzing a reaction at 50° C. may be so inefficient at 35° C., that its use at the lower temperature will not be feasible. For this reason, laundry detergents generally contain a selection of proteolytic enzymes, allowing the detergent to be used over a broad range of wash temperature and pH. In view of the specificity of enzymes and the growing use of hydrolases in industry, research, and medicine, there is an ongoing need in the art for new enzymes and new enzyme inhibitors.

SUMMARY

The invention provides polypeptides, for example, enzymes and catalytic antibodies, having a hydrolase activity, e.g., an esterase, acylase, lipase, phospholipase or protease activity, including thermostable and thermotolerant hydrolase activities, and enantiospecific activities, and polynucleotides encoding these polypeptides, including vectors, host cells, transgenic plants and non-human animals, and methods for making and using these polynucleotides and polypeptides.

The invention provides isolated or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 10, 15, 20, 25, 30, 35, 40, 45, 50, 55, 60, 65, 70, 75, 100, 125, 150, 175, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues, wherein the nucleic acid encodes at least one polypeptide having a hydrolase activity, e.g., an esterase, acylase, lipase, phospholipase or protease activity. The sequence identities can be determined by analysis with a sequence comparison algorithm or by a visual inspection. Exemplary nucleic acids of the invention include isolated or recombinant nucleic acids comprising a nucleic acid sequence as set forth in SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID
NO:405, SEQ ID NO:407, SEQ ID NO:409, SEQ ID
NO:411, SEQ ID NO:413, SEQ ID NO:415, SEQ ID
NO:417, SEQ ID NO:419, SEQ ID NO:421, SEQ ID
NO:423, SEQ ID NO:425, SEQ ID NO:427, SEQ ID
NO:429, SEQ ID NO:431, SEQ ID NO:433, SEQ ID
NO:435, SEQ ID NO:437, SEQ ID NO:439, SEQ ID
NO:441, SEQ ID NO:443, SEQ ID NO:445, SEQ ID
NO:447, SEQ ID NO:449, SEQ ID NO:451, SEQ ID
NO:453, SEQ ID NO:455, SEQ ID NO:457, SEQ ID
NO:459, SEQ ID NO:461, SEQ ID NO:463, SEQ ID
NO:465, SEQ ID NO:467, SEQ ID NO:469, SEQ ID
NO:471, SEQ ID NO:473, SEQ ID NO:475, SEQ ID
NO:477, SEQ ID NO:479, SEQ ID NO:481, SEQ ID
NO:483, SEQ ID NO:485, SEQ ID NO:487, SEQ ID
NO:489, SEQ ID NO:491, SEQ ID NO:493, SEQ ID
NO:495, SEQ ID NO:497, SEQ ID NO:499, SEQ ID
NO:501, SEQ ID NO:503, SEQ ID NO:505, SEQ ID
NO:507, SEQ ID NO:509, SEQ ID NO:511, SEQ ID
NO:513, SEQ ID NO:515, SEQ ID NO:517, SEQ ID
NO:519, SEQ ID NO:521, SEQ ID NO:523, SEQ ID
NO:525, SEQ ID NO:527, SEQ ID NO:529, SEQ ID
NO:531, SEQ ID NO:533, SEQ ID NO:535, SEQ ID
NO:537, SEQ ID NO:539, SEQ ID NO:541, SEQ ID
NO:543, SEQ ID NO:545, SEQ ID NO:547, SEQ ID
NO:549, SEQ ID NO:551, SEQ ID NO:553, SEQ ID
NO:555, SEQ ID NO:557, SEQ ID NO:559, SEQ ID
NO:561, SEQ ID NO:563, SEQ ID NO:565, SEQ ID
NO:567, SEQ ID NO:569, SEQ ID NO:571, SEQ ID
NO:573, SEQ ID NO:575, SEQ ID NO:577, SEQ ID
NO:579, SEQ ID NO:581, SEQ ID NO:583, SEQ ID
NO:585, SEQ ID NO:587, SEQ ID NO:589, SEQ ID
NO:591, SEQ ID NO:593, SEQ ID NO:595, SEQ ID
NO:597, SEQ ID NO:599, SEQ ID NO:601, SEQ ID
NO:603, SEQ ID NO:605, SEQ ID NO:607, SEQ ID
NO:609, SEQ ID NO:611, SEQ ID NO:613, SEQ ID
NO:615, SEQ ID NO:617, SEQ ID NO:619, SEQ ID
NO:621, SEQ ID NO:623, SEQ ID NO:625, SEQ ID
NO:627, SEQ ID NO:629, SEQ ID NO:631, SEQ ID
NO:633, SEQ ID NO:635, SEQ ID NO:637, SEQ ID
NO:639, SEQ ID NO:641, SEQ ID NO:643, SEQ ID
NO:645, SEQ ID NO:647, SEQ ID NO:649, SEQ ID
NO:651, SEQ ID NO:653, SEQ ID NO:655, SEQ ID
NO:657, SEQ ID NO:659, SEQ ID NO:661, SEQ ID
NO:663, SEQ ID NO:665, SEQ ID NO:667, SEQ ID
NO:669, SEQ ID NO:671, SEQ ID NO:673, SEQ ID
NO:675, SEQ ID NO:677, SEQ ID NO:679, SEQ ID
NO:681, SEQ ID NO:683, SEQ ID NO:685, SEQ ID
NO:687, SEQ ID NO:689, SEQ ID NO:691, SEQ ID
NO:693, SEQ ID NO:695, SEQ ID NO:697, SEQ ID
NO:699, SEQ ID NO:701, SEQ ID NO:703, SEQ ID
NO:705, SEQ ID NO:707, SEQ ID NO:709, SEQ ID
NO:711, SEQ ID NO:713, SEQ ID NO:715, SEQ ID
NO:717, SEQ ID NO:719, SEQ ID NO:721, SEQ ID
NO:723, SEQ ID NO:725, SEQ ID NO:727, SEQ ID
NO:729, SEQ ID NO:731, SEQ ID NO:733, SEQ ID
NO:735, SEQ ID NO:737, SEQ ID NO:739, SEQ ID
NO:741, SEQ ID NO:743, SEQ ID NO:745, SEQ ID
NO:747, SEQ ID NO:749, SEQ ID NO:751, SEQ ID
NO:753, SEQ ID NO:755, SEQ ID NO:757, SEQ ID
NO:759, SEQ ID NO:761, SEQ ID NO:763, SEQ ID
NO:765, SEQ ID NO:767, SEQ ID NO:769, SEQ ID
NO:771, SEQ ID NO:773, SEQ ID NO:775, SEQ ID
NO:777, SEQ ID NO:779, SEQ ID NO:781, SEQ ID
NO:783, SEQ ID NO:785, SEQ ID NO:787, SEQ ID
NO:789, SEQ ID NO:791, SEQ ID NO:793, SEQ ID
NO:795, SEQ ID NO:797, SEQ ID NO:799, SEQ ID
NO:801, SEQ ID NO:803, SEQ ID NO:805, SEQ ID
NO:807, SEQ ID NO:809, SEQ ID NO:811, SEQ ID
NO:813, SEQ ID NO:815, SEQ ID NO:817, SEQ ID
NO:819, SEQ ID NO:821, SEQ ID NO:823, SEQ ID
NO:825, SEQ ID NO:827, SEQ ID NO:829, SEQ ID
NO:831, SEQ ID NO:833, SEQ ID NO:835, SEQ ID
NO:837, SEQ ID NO:839, SEQ ID NO:841, SEQ ID
NO:843, SEQ ID NO:845, SEQ ID NO:847, SEQ ID
NO:849, SEQ ID NO:851, SEQ ID NO:853, SEQ ID
NO:855, SEQ ID NO:857, SEQ ID NO:859, SEQ ID
NO:861, SEQ ID NO:863, SEQ ID NO:865, SEQ ID
NO:867, SEQ ID NO:869, SEQ ID NO:871, SEQ ID
NO:873, SEQ ID NO:875, SEQ ID NO:877, SEQ ID
NO:879, SEQ ID NO:881, SEQ ID NO:883, SEQ ID
NO:885, SEQ ID NO:887, SEQ ID NO:889, SEQ ID
NO:891, SEQ ID NO:893, SEQ ID NO:895, SEQ ID
NO:897, SEQ ID NO:899, SEQ ID NO:901, SEQ ID
NO:903, SEQ ID NO:905, SEQ ID NO:907, SEQ ID
NO:909, SEQ ID NO:911, SEQ ID NO:913, SEQ ID
NO:915, SEQ ID NO:917, SEQ ID NO:919, SEQ ID
NO:921, SEQ ID NO:923, SEQ ID NO:925, SEQ ID
NO:927, SEQ ID NO:929, SEQ ID NO:931, SEQ ID
NO:933, SEQ ID NO:935, SEQ ID NO:937, SEQ ID
NO:939, SEQ ID NO:941, SEQ ID NO:943, SEQ ID
NO:945, SEQ ID NO:947, SEQ ID NO:949, SEQ ID NO:951
or SEQ ID NO:953, and subsequences thereof, e.g., at least
about 10, 15, 20, 25, 30, 35, 40, 45, 50, 75, 100, 150, 200, 250,
300, 350, 400, 450, 500, 550, 600, 650, 700, 750, 800, 850,
900, 950, 1000, 1050, 1100, 1150, 1200, 1250, 1300, 1350,
1400, 1450, 1500 or more residues in length, or over the full
length of a gene or transcript.

Additionally, exemplary nucleic acids of the invention include isolated, synthetic or recombinant nucleic acids comprising a nucleic acid sequence as set forth in SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, SEQ ID NO:975, SEQ ID NO:977, SEQ ID NO:979, SEQ ID NO:981, or SEQ ID NO:983, and subsequences thereof.

Exemplary nucleic acids of the invention also include isolated or recombinant nucleic acids encoding a polypeptide having a sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID
NO:170, SEQ ID NO:172, SEQ ID NO:174, SEQ ID
NO:176, SEQ ID NO:178, SEQ ID NO:180, SEQ ID
NO:182, SEQ ID NO:184, SEQ ID NO:186, SEQ ID
NO:188, SEQ ID NO:190, SEQ ID NO:192, SEQ ID
NO:194, SEQ ID NO:196, SEQ ID NO:198, SEQ ID
NO:200, SEQ ID NO:202, SEQ ID NO:204, SEQ ID
NO:206, SEQ ID NO:208, SEQ ID NO:210, SEQ ID
NO:212, SEQ ID NO:214, SEQ ID NO:216, SEQ ID
NO:218, SEQ ID NO:220, SEQ ID NO:222, SEQ ID
NO:224, SEQ ID NO:226, SEQ ID NO:228, SEQ ID
NO:230, SEQ ID NO:232, SEQ ID NO:234, SEQ ID
NO:236, SEQ ID NO:238, SEQ ID NO:240, SEQ ID
NO:242, SEQ ID NO:244, SEQ ID NO:246, SEQ ID
NO:248, SEQ ID NO:250, SEQ ID NO:252, SEQ ID
NO:254, SEQ ID NO:256, SEQ ID NO:258, SEQ ID
NO:260, SEQ ID NO:262, SEQ ID NO:264, SEQ ID
NO:266, SEQ ID NO:268, SEQ ID NO:270, SEQ ID
NO:272, SEQ ID NO:274, SEQ ID NO:276, SEQ ID
NO:278, SEQ ID NO:280, SEQ ID NO:282, SEQ ID
NO:284, SEQ ID NO:286, SEQ ID NO:288, SEQ ID
NO:290, SEQ ID NO:292, SEQ ID NO:294, SEQ ID
NO:296, SEQ ID NO:298, SEQ ID NO:300, SEQ ID
NO:302, SEQ ID NO:304, SEQ ID NO:306, SEQ ID
NO:308, SEQ ID NO:310, SEQ ID NO:312, SEQ ID
NO:314, SEQ ID NO:316, SEQ ID NO:318, SEQ ID
NO:320, SEQ ID NO:322, SEQ ID NO:324, SEQ ID
NO:326, SEQ ID NO:328, SEQ ID NO:330, SEQ ID
NO:332, SEQ ID NO:334, SEQ ID NO:336, SEQ ID
NO:338, SEQ ID NO:340, SEQ ID NO:342, SEQ ID
NO:344, SEQ ID NO:346, SEQ ID NO:348, SEQ ID
NO:350, SEQ ID NO:352, SEQ ID NO:354, SEQ ID
NO:356, SEQ ID NO:358, SEQ ID NO:360, SEQ ID
NO:362, SEQ ID NO:364, SEQ ID NO:366, SEQ ID
NO:368, SEQ ID NO:370, SEQ ID NO:372, SEQ ID
NO:374, SEQ ID NO:376, SEQ ID NO:378, SEQ ID
NO:380, SEQ ID NO:382, SEQ ID NO:384, SEQ ID
NO:386, SEQ ID NO:388, SEQ ID NO:390, SEQ ID
NO:392, SEQ ID NO:394, SEQ ID NO:396, SEQ ID
NO:398, SEQ ID NO:400, SEQ ID NO:402, SEQ ID
NO:404, SEQ ID NO:406, SEQ ID NO:408, SEQ ID
NO:410, SEQ ID NO:412, SEQ ID NO:414, SEQ ID
NO:416, SEQ ID NO:418, SEQ ID NO:420, SEQ ID
NO:422, SEQ ID NO:424, SEQ ID NO:426, SEQ ID
NO:428, SEQ ID NO:430, SEQ ID NO:432, SEQ ID
NO:434, SEQ ID NO:436, SEQ ID NO:438, SEQ ID
NO:440, SEQ ID NO:442, SEQ ID NO:444, SEQ ID
NO:446, SEQ ID NO:448, SEQ ID NO:450, SEQ ID
NO:452, SEQ ID NO:454, SEQ ID NO:456, SEQ ID
NO:458, SEQ ID NO:460, SEQ ID NO:462, SEQ ID
NO:464, SEQ ID NO:466, SEQ ID NO:468, SEQ ID
NO:470, SEQ ID NO:472, SEQ ID NO:474, SEQ ID
NO:476, SEQ ID NO:478, SEQ ID NO:480, SEQ ID
NO:482, SEQ ID NO:484, SEQ ID NO:486, SEQ ID
NO:488, SEQ ID NO:490, SEQ ID NO:492, SEQ ID
NO:494, SEQ ID NO:496, SEQ ID NO:498, SEQ ID
NO:500, SEQ ID NO:502, SEQ ID NO:504, SEQ ID
NO:506, SEQ ID NO:508, SEQ ID NO:510, SEQ ID
NO:512, SEQ ID NO:514, SEQ ID NO:516, SEQ ID
NO:518, SEQ ID NO:520, SEQ ID NO:522, SEQ ID
NO:524, SEQ ID NO:526, SEQ ID NO:528, SEQ ID
NO:530, SEQ ID NO:532, SEQ ID NO:534, SEQ ID
NO:536, SEQ ID NO:538, SEQ ID NO:540, SEQ ID
NO:542, SEQ ID NO:544, SEQ ID NO:546, SEQ ID
NO:548, SEQ ID NO:550, SEQ ID NO:552, SEQ ID
NO:554, SEQ ID NO:556, SEQ ID NO:558, SEQ ID
NO:560, SEQ ID NO:562, SEQ ID NO:564, SEQ ID
NO:566, SEQ ID NO:568, SEQ ID NO:570, SEQ ID
NO:572, SEQ ID NO:574, SEQ ID NO:576, SEQ ID
NO:578, SEQ ID NO:580, SEQ ID NO:582, SEQ ID
NO:584, SEQ ID NO:586, SEQ ID NO:588, SEQ ID
NO:590, SEQ ID NO:592, SEQ ID NO:594, SEQ ID
NO:596, SEQ ID NO:598, SEQ ID NO:600, SEQ ID
NO:602, SEQ ID NO:604, SEQ ID NO:606, SEQ ID
NO:608, SEQ ID NO:610, SEQ ID NO:612, SEQ ID
NO:614, SEQ ID NO:616, SEQ ID NO:618, SEQ ID
NO:620, SEQ ID NO:622, SEQ ID NO:624, SEQ ID
NO:626, SEQ ID NO:628, SEQ ID NO:630, SEQ ID
NO:632, SEQ ID NO:634, SEQ ID NO:636, SEQ ID
NO:638, SEQ ID NO:640, SEQ ID NO:642, SEQ ID
NO:644, SEQ ID NO:646, SEQ ID NO:648, SEQ ID
NO:650, SEQ ID NO:652, SEQ ID NO:654, SEQ ID
NO:656, SEQ ID NO:658, SEQ ID NO:660, SEQ ID
NO:662, SEQ ID NO:664, SEQ ID NO:666, SEQ ID
NO:668, SEQ ID NO:670, SEQ ID NO:672, SEQ ID
NO:674, SEQ ID NO:676, SEQ ID NO:678, SEQ ID
NO:680, SEQ ID NO:682, SEQ ID NO:684, SEQ ID
NO:686, SEQ ID NO:688, SEQ ID NO:690, SEQ ID
NO:692, SEQ ID NO:694, SEQ ID NO:696, SEQ ID
NO:698, SEQ ID NO:700, SEQ ID NO:702, SEQ ID
NO:704, SEQ ID NO:706, SEQ ID NO:708, SEQ ID
NO:710, SEQ ID NO:712, SEQ ID NO:714, SEQ ID
NO:716, SEQ ID NO:718, SEQ ID NO:720, SEQ ID
NO:722, SEQ ID NO:724, SEQ ID NO:726, SEQ ID
NO:728, SEQ ID NO:730, SEQ ID NO:732, SEQ ID
NO:734, SEQ ID NO:736, SEQ ID NO:738, SEQ ID
NO:740, SEQ ID NO:742, SEQ ID NO:744, SEQ ID
NO:746, SEQ ID NO:748, SEQ ID NO:750, SEQ ID
NO:752, SEQ ID NO:754, SEQ ID NO:756, SEQ ID
NO:758, SEQ ID NO:760, SEQ ID NO:762, SEQ ID
NO:764, SEQ ID NO:766, SEQ ID NO:768, SEQ ID
NO:770, SEQ ID NO:772, SEQ ID NO:774, SEQ ID
NO:776, SEQ ID NO:778, SEQ ID NO:780, SEQ ID
NO:782, SEQ ID NO:784, SEQ ID NO:786, SEQ ID
NO:788, SEQ ID NO:790, SEQ ID NO:792, SEQ ID
NO:794, SEQ ID NO:796, SEQ ID NO:798, SEQ ID
NO:800, SEQ ID NO:802, SEQ ID NO:804, SEQ ID
NO:808, SEQ ID NO:808, SEQ ID NO:810, SEQ ID
NO:812, SEQ ID NO:814, SEQ ID NO:816, SEQ ID
NO:818, SEQ ID NO:820, SEQ D NO:822, SEQ ID NO:824,
SEQ ID NO:826, SEQ ID NO:828, SEQ ID NO:830, SEQ
NO:832, SEQ ID NO:834, SEQ ID NO:836, SEQ ID
NO:838, SEQ ID NO:840, SEQ ID NO:842, SEQ ID
NO:844, SEQ ID NO:846, SEQ ID NO:848, SEQ ID
NO:850, SEQ ID NO:852, SEQ ID NO:854, SEQ ID
NO:856, SEQ ID NO:858, SEQ ID NO:860, SEQ ID
NO:862, SEQ ID NO:864, SEQ ID NO:866, SEQ ID
NO:868, SEQ ID NO:870, SEQ ID NO:872, SEQ ID
NO:874, SEQ ID NO:876, SEQ ID NO:878, SEQ ID
NO:880, SEQ ID NO:882, SEQ ID NO:884, SEQ ID
NO:886, SEQ ID NO:888, SEQ ID NO:890, SEQ ID
NO:892, SEQ ID NO:894, SEQ ID NO:896, SEQ ID
NO:898, SEQ ID NO:900, SEQ ID NO:902, SEQ ID
NO:904, SEQ ID NO:906, SEQ ID NO:908, SEQ ID
NO:910, SEQ ID NO:912, SEQ ID NO:914, SEQ ID
NO:916, SEQ ID NO:918, SEQ ID NO:920, SEQ ID
NO:922, SEQ ID NO:924, SEQ ID NO:926, SEQ ID
NO:928, SEQ ID NO:930, SEQ ID NO:932, SEQ ID
NO:934, SEQ ID NO:936, SEQ ID NO:938, SEQ ID
NO:940, SEQ ID NO:942, SEQ ID NO:944, SEQ ID
NO:946, SEQ ID NO:948, SEQ ID NO:950, SEQ ID NO:952
or SEQ ID NO:954, and subsequences thereof and variants
thereof. In one aspect, the polypeptide has a hydrolase activity, e.g., an esterase, acylase, lipase, phospholipase or protease activity. In one aspect, the hydrolase activity is a regioselective and/or chemoselective activity.

Additionally, exemplary nucleic acids of the invention also include isolated, synthetic or recombinant nucleic acids encoding a polypeptide having a sequence as set forth in SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974, SEQ ID NO:976, SEQ ID NO:978, SEQ ID NO:980, SEQ ID NO:982, or SEQ ID NO:984, and subsequences thereof and variants thereof.

In one aspect, the invention also provides hydrolase-encoding nucleic acids with a common novelty in that they are derived from mixed cultures. The invention provides hydrolase-encoding nucleic acids isolated from mixed cultures comprising a nucleic acid of the invention, e.g., a nucleic acid having a sequence at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 10, 20, 30, 40, 50, 60, 70, 75, 100, 125, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues, wherein the nucleic acid encodes at least one polypeptide having a hydrolase activity, and the sequence identities are determined by analysis with a sequence comparison algorithm or by a visual inspection. In one aspect, the invention provides hydrolase-encoding nucleic acids isolated from mixed cultures comprising a nucleic acid of the invention.

In one aspect, the invention also provides hydrolase-encoding nucleic acids with a common novelty in that they are derived from environmental sources, e.g., mixed environmental sources. In one aspect, the invention provides hydrolase-encoding nucleic acids isolated from environmental sources, e.g., mixed environmental sources, comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 10, 15, 20, 25, 30, 35, 40, 45, 50, 55, 60, 65, 70, 75, 100, 125, 150, 175, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues, wherein the nucleic acid encodes at least one polypeptide having a hydrolase activity, and the sequence identities are determined by analysis with a sequence comparison algorithm or by a visual inspection. In one aspect, the invention provides hydrolase-encoding nucleic acids isolated from environmental sources, e.g., mixed environmental sources, comprising a nucleic acid of the invention.

In one aspect, the sequence comparison algorithm is a BLAST version 2.2.2 algorithm where a filtering setting is set to blastall -p blastp -d "nr pataa"-F F, and all other options are set to default.

Another aspect of the invention is an isolated or recombinant nucleic acid including at least 10 consecutive bases of a nucleic acid sequence of the invention, sequences substantially identical thereto, and the sequences complementary thereto.

In one aspect, the lipase activity comprises hydrolyzing a triacylglycerol (TAG), a diacylglycerol (DAG) or a monoacylglycerol (MAG). The lipase activity can comprise hydrolyzing a triacylglycerol to a diacylglycerol and a free fatty acid, or, hydrolyzing a triacylglycerol to a monoacylglycerol and free fatty acids, or, hydrolyzing a diacylglycerol to a monoacylglycerol and free fatty acids, or, hydrolyzing a monoacylglycerol to a free fatty acid and a glycerol. The lipase activity can comprise synthesizing a tryacylglycerol from a diacylglycerol or a monoacylglycerol and free fatty acids. The lipase activity can comprise synthesizing 1,3-di-palmitoyl-2-oleoylglycerol (POP), 1,3-distearoyl-2-oleoylglycerol (SOS), 1-palmitoyl-2-oleoyl-3-stearoylglycerol (POS) or 1-oleoyl-2,3-dimyristoylglycerol (OMM), long chain polyunsaturated fatty acids, arachidonic acid, docosahexaenoic acid (DHA) or eicosapentaenoic acid (EPA). The lipase activity can be triacylglycerol (TAG), diacylglycerol (DAG) or monoacylglycerol (MAG) position-specific. The lipase activity can be Sn2-specific, Sn1-or Sn3-specific. The lipase activity can be fatty acid specific. The lipase activity can comprise modifying oils by hydrolysis, alcoholysis, esterification, transesterification or interesterification. The lipase activity can be regio-specific or chemoselective. The lipase activity can comprise synthesis of enantiomerically pure chiral products. The lipase activity can comprise synthesis of umbelliferyl fatty acid (FA) esters.

In one aspect, the isolated or recombinant nucleic acid encodes a polypeptide having a hydrolase activity, e.g., an esterase, acylase, lipase, phospholipase or protease activity, which is thermostable. The polypeptide can retain activity under conditions comprising a temperature range of between about 37° C. to about 95° C.; between about 55° C. to about 85° C., between about 70° C. to about 95° C., or, between about 90° C. to about 95° C.

In another aspect, the isolated or recombinant nucleic acid encodes a polypeptide having a hydrolase activity, e.g., an esterase, acylase, lipase, phospholipase or protease activity, which is thermotolerant. The polypeptide can retain activity after exposure to a temperature in the range from greater than 37° C. to about 95° C. or anywhere in the range from greater than 55° C. to about 85° C. In one aspect, the polypeptide retains activity after exposure to a temperature in the range from greater than 90° C. to about 95° C. at pH 4.5.

The invention provides isolated or recombinant nucleic acids comprising a sequence that hybridizes under stringent conditions to a nucleic acid of the invention, e.g., an exemplary nucleic acid of the invention comprising a sequence as set forth in SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID
NO:123, SEQ ID NO:125, SEQ ID NO:127, SEQ ID
NO:129, SEQ ID NO:131, SEQ ID NO:133, SEQ ID
NO:135, SEQ ID NO:137, SEQ ID NO:139, SEQ ID
NO:141, SEQ ID NO:143, SEQ ID NO:145, SEQ ID
NO:147, SEQ ID NO:149, SEQ ID NO:151, SEQ ID
NO:153, SEQ ID NO:155, SEQ ID NO:157, SEQ ID
NO:159, SEQ ID NO:161, SEQ ID NO:163, SEQ ID
NO:165, SEQ ID NO:167, SEQ ID NO:169, SEQ ID
NO:171, SEQ ID NO:173, SEQ ID NO:175, SEQ ID
NO:177, SEQ ID NO:179, SEQ ID NO:181, SEQ ID
NO:183, SEQ ID NO:185, SEQ ID NO:187, SEQ ID
NO:189, SEQ ID NO:191, SEQ ID NO:193, SEQ ID
NO:195, SEQ ID NO:197, SEQ ID NO:199, SEQ ID
NO:201, SEQ ID NO:203, SEQ ID NO:205, SEQ ID
NO:207, SEQ ID NO:209, SEQ ID NO:211, SEQ ID
NO:213, SEQ ID NO:215, SEQ ID NO:217, SEQ ID
NO:219, SEQ ID NO:221, SEQ ID NO:223, SEQ ID
NO:225, SEQ ID NO:227, SEQ ID NO:229, SEQ ID
NO:231, SEQ ID NO:233, SEQ ID NO:235, SEQ ID
NO:237, SEQ ID NO:239, SEQ ID NO:241, SEQ ID
NO:243, SEQ ID NO:245, SEQ ID NO:247, SEQ ID
NO:249, SEQ ID NO:251, SEQ ID NO:253, SEQ ID
NO:255, SEQ ID NO:257, SEQ ID NO:259, SEQ ID
NO:261, SEQ ID NO:263, SEQ ID NO:265, SEQ ID
NO:267, SEQ ID NO:269, SEQ ID NO:271, SEQ ID
NO:273, SEQ ID NO:275, SEQ ID NO:277, SEQ ID
NO:279, SEQ ID NO:281, SEQ ID NO:283, SEQ ID
NO:285, SEQ ID NO:287, SEQ ID NO:289, SEQ ID
NO:291, SEQ ID NO:293, SEQ ID NO:295, SEQ ID
NO:297, SEQ ID NO:299, SEQ ID NO:301, SEQ ID
NO:303, SEQ ID NO:305, SEQ ID NO:307, SEQ ID
NO:309, SEQ ID NO:311, SEQ ID NO:313, SEQ ID
NO:315, SEQ ID NO:317, SEQ ID NO:319, SEQ ID
NO:321, SEQ ID NO:323, SEQ ID NO:325, SEQ ID
NO:327, SEQ ID NO:329, SEQ ID NO:331, SEQ ID
NO:333, SEQ ID NO:335, SEQ ID NO:337, SEQ ID
NO:339, SEQ ID NO:341, SEQ ID NO:343, SEQ ID
NO:345, SEQ ID NO:347, SEQ ID NO:349, SEQ ID
NO:351, SEQ ID NO:353, SEQ ID NO:355, SEQ ID
NO:357, SEQ ID NO:359, SEQ ID NO:361, SEQ ID
NO:363, SEQ ID NO:365, SEQ ID NO:367, SEQ ID
NO:369, SEQ ID NO:371, SEQ ID NO:373, SEQ ID
NO:375, SEQ ID NO:377, SEQ ID NO:379, SEQ ID
NO:381, SEQ ID NO:383, SEQ ID NO:385, SEQ ID
NO:387, SEQ ID NO:389, SEQ ID NO:391, SEQ ID
NO:393, SEQ ID NO:395, SEQ ID NO:397, SEQ ID
NO:399, SEQ ID NO:401, SEQ BD NO:403, SEQ ID
NO:405, SEQ ID NO:407, SEQ ID NO:409, SEQ ID
NO:411, SEQ ID NO:413, SEQ ID NO:415, SEQ ID
NO:417, SEQ ID NO:419, SEQ ID NO:421, SEQ ID
NO:423, SEQ D NO:425, SEQ ID NO:427, SEQ ID NO:429,
SEQ ID NO:431, SEQ ID NO:433, SEQ ID NO:435, SEQ ID
NO:437, SEQ ID NO:439, SEQ ID NO:441, SEQ ID
NO:443, SEQ ID NO:445, SEQ ID NO:447, SEQ ID
NO:449, SEQ ID NO:451, SEQ ID NO:453, SEQ ID
NO:455, SEQ ID NO:457, SEQ ID NO:459, SEQ ID
NO:461, SEQ ID NO:463, SEQ ID NO:465, SEQ ID
NO:467, SEQ ID NO:469, SEQ ID NO:471, SEQ ID
NO:473, SEQ ID NO:475, SEQ ID NO:477, SEQ ID
NO:479, SEQ ID NO:481, SEQ ID NO:483, SEQ ID
NO:485, SEQ ID NO:487, SEQ ID NO:489, SEQ ID
NO:491, SEQ ID NO:493, SEQ ID NO:495, SEQ ID
NO:497, SEQ ID NO:499, SEQ ID NO:501, SEQ ID
NO:503, SEQ ID NO:505, SEQ ID NO:507, SEQ ID
NO:509, SEQ ID NO:511, SEQ ID NO:513, SEQ ID
NO:515, SEQ ID NO:517, SEQ ID NO:519, SEQ ID
NO:521, SEQ ID NO:523, SEQ ID NO:525, SEQ ID
NO:527, SEQ ID NO:529, SEQ ID NO:531, SEQ ID
NO:533, SEQ ID NO:535, SEQ ID NO:537, SEQ ID
NO:539, SEQ ID NO:541, SEQ ID NO:543, SEQ ID
NO:545, SEQ ID NO:547, SEQ ID NO:549, SEQ ID
NO:551, SEQ ID NO:553, SEQ ID NO:555, SEQ ID
NO:557, SEQ ID NO:559, SEQ ID NO:561, SEQ ID
NO:563, SEQ ID NO:565, SEQ ID NO:567, SEQ ID
NO:569, SEQ ID NO:571, SEQ ID NO:573, SEQ ID
NO:575, SEQ ID NO:577, SEQ ID NO:579, SEQ ID
NO:581, SEQ ID NO:583, SEQ ID NO:585, SEQ ID
NO:587, SEQ ID NO:589, SEQ ID NO:591, SEQ ID
NO:593, SEQ ID NO:595, SEQ ID NO:597, SEQ ID
NO:599, SEQ ID NO:601, SEQ ID NO:603, SEQ ID
NO:605, SEQ ID NO:607, SEQ ID NO:609, SEQ ID
NO:611, SEQ ID NO:613, SEQ ID NO:615, SEQ ID
NO:617, SEQ ID NO:619, SEQ ID NO:621, SEQ ID
NO:623, SEQ ID NO:625, SEQ ID NO:627, SEQ ID
NO:629, SEQ ID NO:631, SEQ ID NO:633, SEQ ID
NO:635, SEQ ID NO:637, SEQ ID NO:639, SEQ ID
NO:641, SEQ ID NO:643, SEQ ID NO:645, SEQ ID
NO:647, SEQ ID NO:649, SEQ ID NO:651, SEQ ID
NO:653, SEQ ID NO:655, SEQ ID NO:657, SEQ ID
NO:659, SEQ ID NO:661, SEQ ID NO:663, SEQ ID
NO:665, SEQ ID NO:667, SEQ ID NO:669, SEQ ID
NO:671, SEQ ID NO:673, SEQ ID NO:675, SEQ ID
NO:677, SEQ ID NO:679, SEQ ID NO:681, SEQ ID
NO:683, SEQ ID NO:685, SEQ ID NO:687, SEQ ID
NO:689, SEQ ID NO:691, SEQ ID NO:693, SEQ ID
NO:695, SEQ ID NO:697, SEQ ID NO:699, SEQ ID
NO:701, SEQ ID NO:703, SEQ ID NO:705, SEQ ID
NO:707, SEQ ID NO:709, SEQ ID NO:711, SEQ ID
NO:713, SEQ ID NO:715, SEQ ID NO:717, SEQ ID
NO:719, SEQ ID NO:721, SEQ ID NO:723, SEQ ID
NO:725, SEQ ID NO:727, SEQ ID NO:729, SEQ ID
NO:731, SEQ ID NO:733, SEQ ID NO:735, SEQ ID
NO:737, SEQ ID NO:739, SEQ ID NO:741, SEQ ID
NO:743, SEQ ID NO:745, SEQ ID NO:747, SEQ ID
NO:749, SEQ ID NO:751, SEQ ID NO:753, SEQ ID
NO:755, SEQ ID NO:757, SEQ ID NO:759, SEQ ID
NO:761, SEQ ID NO:763, SEQ ID NO:765, SEQ ID
NO:767, SEQ ID NO:769, SEQ ID NO:771, SEQ ID
NO:773, SEQ ID NO:775, SEQ ID NO:777, SEQ ID
NO:779, SEQ ID NO:781, SEQ ID NO:783, SEQ ID
NO:785, SEQ ID NO:787, SEQ ID NO:789, SEQ ID
NO:791, SEQ ID NO:793, SEQ ID NO:795, SEQ ID
NO:797, SEQ ID NO:799, SEQ ID NO:801, SEQ ID
NO:803, SEQ ID NO:805, SEQ ID NO:807, SEQ ID
NO:809, SEQ ID NO:811, SEQ ID NO:813, SEQ ID
NO:815, SEQ ID NO:817, SEQ ID NO:819, SEQ ID
NO:821, SEQ ID NO:823, SEQ ID NO:825, SEQ ID
NO:827, SEQ ID NO:829, SEQ ID NO:831, SEQ ID
NO:833, SEQ ID NO:835, SEQ ID NO:837, SEQ ID
NO:839, SEQ ID NO:841, SEQ ID NO:843, SEQ ID
NO:845, SEQ ID NO:847, SEQ ID NO:849, SEQ ID
NO:851, SEQ ID NO:853, SEQ ID NO:855, SEQ ID
NO:857, SEQ ID NO:859, SEQ ID NO:861, SEQ ID
NO:863, SEQ ID NO:865, SEQ ID NO:867, SEQ ID
NO:869, SEQ ID NO:871, SEQ ID NO:873, SEQ ID
NO:875, SEQ ID NO:877, SEQ ID NO:879, SEQ ID
NO:881, SEQ ID NO:883, SEQ ID NO:885, SEQ ID
NO:887, SEQ ID NO:889, SEQ ID NO:891, SEQ ID
NO:893, SEQ ID NO:895, SEQ ID NO:897, SEQ ID
NO:899, SEQ ID NO:901, SEQ ID NO:903, SEQ ID
NO:905, SEQ ID NO:907, SEQ ID NO:909, SEQ ID
NO:911, SEQ ID NO:913, SEQ ID NO:915, SEQ ID
NO:917, SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, SEQ ID NO:941, SEQ ID NO:943, SEQ ID NO:945, SEQ ID NO:947, SEQ ID NO:949, SEQ ID NO:951 or SEQ ID NO:953, or fragments or subsequences thereof. In one aspect, the nucleic acid encodes a polypeptide having a hydrolase activity, e.g., an esterase, acylase, lipase, phospholipase or protease activity. The nucleic acid can be at least about 10, 15, 20, 25, 30, 35, 40, 45, 50, 55, 60, 65, 70, 75, 100, 125, 150, 175, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length or the full length of the gene or transcript. In one aspect, the stringent conditions include a wash step comprising a wash in 0.2×SSC at a temperature of about 65° C. for about 15 minutes.

Additionally, the invention provides isolated, synthetic or recombinant nucleic acids comprising a sequence that hybridizes under stringent conditions to a nucleic acid of the invention, e.g., an exemplary nucleic acid of the invention comprising a sequence as set forth in SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, SEQ ID NO:975, SEQ ID NO:977, SEQ ID NO:979, SEQ ID NO:981, or SEQ ID NO:983, or fragments or subsequences thereof.

The invention provides a nucleic acid probe, e.g., a probe for identifying a nucleic acid encoding a polypeptide having a hydrolase activity, e.g., an esterase, acylase, lipase, phospholipase or protease activity, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof. The probe can comprise an oligonucleotide comprising at least about 10 to 50, about 20 to 60, about 30 to 70, about 40 to 80, or about 60 to 100 consecutive bases of a nucleic acid sequence of the invention, or a subsequence thereof.

The invention provides an amplification primer sequence pair for amplifying a nucleic acid encoding a polypeptide having a hydrolase activity, e.g., an esterase, acylase, lipase, phospholipase or protease activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence.

The invention provides methods of amplifying a nucleic acid encoding a polypeptide having a hydrolase activity, e.g., an esterase, acylase, lipase, phospholipase or protease activity, comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a mammalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be a potato, wheat, rice, corn, tobacco or barley cell.

The invention provides transgenic non-human animals comprising a nucleic acid of the invention or an expression cassette (e.g., a vector) of the invention. In one aspect, the animal is a mouse.

The invention provides transgenic plants comprising a nucleic acid of the invention or an expression cassette (e.g., a vector) of the invention. The transgenic plant can be a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be rice, a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of a hydrolase message in a cell comprising administering to the cell or expressing in the cell an antisense oligonucleotide comprising a nucleic acid sequence complementary to or capable of hybridizing under stringent conditions to a nucleic acid of the invention.

The invention provides an isolated or recombinant polypeptide comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or complete (100%) sequence identity to an exemplary polypeptide or peptide of the invention over a region of at least about 10, 15, 20, 25, 30, 35, 40, 45, 50, 55, 60, 65, 70, 75, 100, 125, 150, 175, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more residues, or over the full length of the polypeptide, and the sequence identities are determined by analysis with a sequence comparison algorithm or by a visual inspection. Exemplary polypeptide or peptide sequences of the invention include SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID
NO:810, SEQ ID NO:812, SEQ ID NO:814, SEQ ID
NO:816, SEQ ID NO:818, SEQ ID NO:820, SEQ ID
NO:822, SEQ ID NO:824, SEQ ID NO:826, SEQ ID
NO:828, SEQ ID NO:830, SEQ ID NO:832, SEQ ID
NO:834, SEQ ID NO:836, SEQ ID NO:838, SEQ ID
NO:840, SEQ ID NO:842, SEQ ID NO:844, SEQ ID
NO:846, SEQ ID NO:848, SEQ ID NO:850, SEQ ID
NO:852, SEQ ID NO:854, SEQ ID NO:856, SEQ ID
NO:858, SEQ ID NO:860, SEQ ID NO:862, SEQ ID
NO:864, SEQ ID NO:866, SEQ ID NO:868, SEQ ID
NO:870, SEQ ID NO:872, SEQ ID NO:874, SEQ ID
NO:876, SEQ ID NO:878, SEQ ID NO:880, SEQ ID
NO:882, SEQ ID NO:884, SEQ ID NO:886, SEQ ID
NO:888, SEQ ID NO:890, SEQ ID NO:892, SEQ ID
NO:894, SEQ ID NO:896, SEQ ID NO:898, SEQ ID
NO:900, SEQ ID NO:902, SEQ ID NO:904, SEQ ID
NO:906, SEQ ID NO:908, SEQ ID NO:910, SEQ ID
NO:912, SEQ ID NO:914, SEQ ID NO:916, SEQ ID
NO:918, SEQ ID NO:920, SEQ ID NO:922, SEQ ID
NO:924, SEQ ID NO:926, SEQ ID NO:928, SEQ ID
NO:930, SEQ ID NO:932, SEQ ID NO:934, SEQ ID
NO:936, SEQ ID NO:938, SEQ ID NO:940, SEQ ID
NO:942, SEQ ID NO:944, SEQ ID NO:946, SEQ ID
NO:948, SEQ ID NO:950, SEQ ID NO:952 and SEQ ID
NO:954, and subsequences thereof and variants thereof, e.g., at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length, or over the full length of an enzyme. Exemplary polypeptide or peptide sequences of the invention include sequence encoded by a nucleic acid of the invention. Exemplary polypeptide or peptide sequences of the invention include polypeptides or peptides specifically bound by an antibody of the invention. In one aspect, a polypeptide of the invention has at least one hydrolase activity, e.g., an esterase, acylase, lipase, phospholipase or protease activity. In one aspect, the activity is a regioselective and/or chemoselective activity.

Additionally, exemplary polypeptide or peptide sequences of the invention include SEQ ID NO:956, SEQ ID NO:958, SEQ ID NO:960, SEQ ID NO:962, SEQ ID NO:964, SEQ ID NO:966, SEQ ID NO:968, SEQ ID NO:970, SEQ ID NO:972, SEQ ID NO:974, SEQ ID NO:976, SEQ ID NO:978, SEQ NO:980, SEQ ID NO:982, or SEQ ID NO: 984, and subsequences thereof and variants thereof, e.g., at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length, or over the full length of an enzyme.

Another aspect of the invention is an isolated or recombinant polypeptide or peptide including at least 10 consecutive bases of a polypeptide or peptide sequence of the invention, sequences substantially identical thereto, and the sequences complementary thereto.

In one aspect, the lipase activity comprises hydrolyzing a triacylglycerol (TAG), a diacylglycerol (DAG) or a monoacylglycerol (MAG). The lipase activity can comprise hydrolyzing a triacylglycerol to a diacylglycerol and a free fatty acid, or, hydrolyzing a triacylglycerol to a monoacylglycerol and free fatty acids, or, hydrolyzing a diacylglycerol to a monoacylglycerol and free fatty acids, or, hydrolyzing a monoacylglycerol to a free fatty acid and a glycerol. The lipase activity can comprise synthesizing a tryacylglycerol from a diacylglycerol or a monoacylglycerol and free fatty acids. The lipase activity can comprise synthesizing 1,3-di- palmitoyl-2-oleoylglycerol (POP), 1,3-distearoyl-2-oleoylglycerol (SOS), 1-palmitoyl-2-oleoyl-3-stearoylglycerol (POS) or 1-oleoyl-2,3-dimyristoylglycerol (OMM), long chain polyunsaturated fatty acids, arachidonic acid, docosahexaenoic acid (DHA) or eicosapentaenoic acid (EPA). The lipase activity can be triacylglycerol (TAG), diacylglycerol (DAG) or monoacylglycerol (MAG) position-specific. The lipase activity can be Sn2-specific, Sn1-or Sn3-specific. The lipase activity can be fatty acid specific. The lipase activity can comprise modifying oils by hydrolysis, alcoholysis, esterification, transesterification or interesterification. The lipase activity can be regio-specific or chemoselective. The lipase activity can comprise synthesis of enantiomerically pure chiral products. The lipase activity can comprise synthesis of umbelliferyl fatty acid (FA) esters.

In one aspect, the hydrolase activity can be thermostable. The polypeptide can retain a hydrolase activity under conditions comprising a temperature range of between about 37° C. to about 95° C., between about 55° C. to about 85° C., between about 70° C. to about 95° C., or between about 90° C. to about 95° C. In another aspect, the hydrolase activity can be thermotolerant. The polypeptide can retain a hydrolase activity after exposure to a temperature in the range from greater than 37° C. to about 95° C., or in the range from greater than 55° C. to about 85° C. In one aspect, the polypeptide can retain a hydrolase activity after exposure to a temperature in the range from greater than 90° C. to about 95° C. at pH 4.5.

In one aspect, the isolated or recombinant polypeptide can comprise the polypeptide of the invention that lacks a signal sequence. In one aspect, the isolated or recombinant polypeptide can comprise the polypeptide of the invention comprising a heterologous signal sequence, such as a heterologous hydrolase or non-hydrolase signal sequence. In one aspect, the invention provides chimeric proteins comprising a first domain comprising a signal sequence of the invention and at least a second domain. The protein can be a fusion protein. The second domain can comprise an enzyme. The enzyme can be a hydrolase (e.g., a hydrolase of the invention, or, another hydrolase).

In one aspect, the hydrolase activity comprises a specific activity at about 37° C. in the range from about 100 to about 1000 units per milligram of protein. In another aspect, the hydrolase activity comprises a specific activity from about 500 to about 750 units per milligram of protein. Alternatively, the hydrolase activity comprises a specific activity at 37° C. in the range from about 500 to about 1200 units per milligram of protein. In one aspect, the hydrolase activity comprises a specific activity at 37° C. in the range from about 750 to about 1000 units per milligram of protein. In another aspect, the thermotolerance comprises retention of at least half of the specific activity of the hydrolase at 37° C. after being heated to the elevated temperature. Alternatively, the thermotolerance can comprise retention of specific activity at 37° C. in the range from about 500 to about 1200 units per milligram of protein after being heated to the elevated temperature.

The invention provides the isolated or recombinant polypeptide of the invention, wherein the polypeptide comprises at least one glycosylation site. In one aspect, glycosylation can be an N-linked glycosylation. In one aspect, the polypeptide can be glycosylated after being expressed in a *P. pastoris* or a *S. pombe*.

In one aspect, the polypeptide can retain a hydrolase activity under conditions comprising about pH 6.5, pH 6, pH 5.5, pH 5, pH 4.5 or pH 4. In another aspect, the polypeptide can retain a hydrolase activity under conditions comprising about pH 7, pH 7.5 pH 8.0, pH 8.5, pH 9, pH 9.5, pH 10, pH 10.5 or pH 11.

The invention provides protein preparations comprising a polypeptide of the invention, wherein the protein preparation comprises a liquid, a solid or a gel.

The invention provides heterodimers comprising a polypeptide of the invention and a second domain. In one aspect, the second domain can be a polypeptide and the heterodimer can be a fusion protein. In one aspect, the second domain can be an epitope or a tag. In one aspect, the invention provides homodimers comprising a polypeptide of the invention.

The invention provides immobilized polypeptides having a hydrolase activity, wherein the polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a microelectrode, a graphitic particle, a bead, a gel, a plate, an array or a capillary tube.

The invention provides arrays comprising an immobilized nucleic acid of the invention. The invention provides arrays comprising an antibody of the invention.

The invention provides isolated or recombinant antibodies that specifically bind to a polypeptide of the invention or to a polypeptide encoded by a nucleic acid of the invention. The antibody can be a monoclonal or a polyclonal antibody. The invention provides hybridomas comprising an antibody of the invention, e.g., an antibody that specifically binds to a polypeptide of the invention or to a polypeptide encoded by a nucleic acid of the invention.

The invention provides food supplements for an animal comprising a polypeptide of the invention, e.g., a polypeptide encoded by the nucleic acid of the invention. In one aspect, the polypeptide in the food supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the hydrolase activity is thermotolerant. In another aspect, the hydrolase activity is thermostable.

The invention provides method of isolating or identifying a polypeptide having a hydrolase activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having a hydrolase activity.

The invention provides methods of making an anti-hydrolase antibody comprising administering to a non-human animal a nucleic acid of the invention or a polypeptide of the invention or subsequences thereof in an amount sufficient to generate a humoral immune response, thereby making an anti-hydrolase antibody. The invention provides methods of making an anti-hydrolase immune comprising administering to a non-human animal a nucleic acid of the invention or a polypeptide of the invention or subsequences thereof in an amount sufficient to generate an immune response.

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having a hydrolase activity comprising the following steps: (a) providing a polypeptide of the invention; or a polypeptide encoded by a nucleic acid of the invention; (b) providing a hydrolase substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having a hydrolase activity. In alternative aspects, the substrate can be a poly-unsaturated fatty acid (PUFA), a diacylglyceride, e.g., a 1,3-diacyl glyceride (DAG), a monoglyceride, e.g., 2-monoglyceride (MAG) or a triacylglyceride (TAG).

The invention provides methods for identifying a hydrolase substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a hydrolase substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of a hydrolase activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the hydrolase, wherein a change in the hydrolase activity measured in the presence of the test compound compared to the activity in the absence of the test compound provides a determination that the test compound modulates the hydrolase activity. In one aspect, the hydrolase activity can be measured by providing a hydrolase substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of hydrolase activity. An increase in the amount of the substrate or a decrease in the amount of the reaction product with the test compound as compared to the amount of substrate or reaction product without the test compound identifies the test compound as an inhibitor of hydrolase activity.

The invention provides computer systems comprising a processor and a data storage device wherein said data storage device has stored thereon a polypeptide sequence or a nucleic acid sequence of the invention (e.g., a polypeptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having a hydrolase activity from an environmental sample comprising the steps of: (a) providing an amplification primer sequence pair for amplifying a nucleic acid encoding a polypeptide having a hydrolase activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having a hydrolase activity from an environmental sample. One or each member of the amplification primer sequence pair can comprise an oligonucleotide comprising at least about 10 to 50 consecutive bases of a sequence of the invention.

The invention provides methods for isolating or recovering a nucleic acid encoding a polypeptide having a hydrolase activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having a hydrolase activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having a hydrolase activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant hydrolase polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a hydrolase having an altered or different activity or an altered or different stability from that of a polypeptide encoded by the template nucleic acid is produced. In one aspect, the variant hydrolase polypeptide is thermotolerant, and retains some activity after being exposed to an elevated temperature. In another aspect, the variant hydrolase polypeptide has increased glycosylation as compared to the hydrolase encoded by a template nucleic acid. Alternatively, the variant hydrolase polypeptide has a hydrolase activity under a high temperature, wherein the hydrolase encoded by the template nucleic acid is not active under the high temperature. In one aspect, the method can be iteratively repeated until a hydrolase coding sequence having an altered codon usage from that of the template nucleic acid is produced. In another aspect, the method can be iteratively repeated until a hydrolase gene having higher or lower level of message expression or stability from that of the template nucleic acid is produced.

The invention provides methods for modifying codons in a nucleic acid encoding a polypeptide having a hydrolase activity to increase its expression in a host cell, the method comprising the following steps: (a) providing a nucleic acid of the invention encoding a polypeptide having a hydrolase activity; and, (b) identifying a non-preferred or a less preferred codon in the nucleic acid of step (a) and replacing it with a preferred or neutrally used codon encoding the same amino acid as the replaced codon, wherein a preferred codon is a codon overrepresented in coding sequences in genes in the host cell and a non-preferred or less preferred codon is a codon underrepresented in coding sequences in genes in the host cell, thereby modifying the nucleic acid to increase its expression in a host cell.

The invention provides methods for modifying codons in a nucleic acid encoding a polypeptide having a hydrolase activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding a hydrolase.

The invention provides methods for modifying codons in a nucleic acid encoding a polypeptide having a hydrolase activity to increase its expression in a host cell, the method comprising the following steps: (a) providing a nucleic acid of the invention encoding a hydrolase polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having a hydrolase activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified hydrolase active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes a hydrolase active site or a hydrolase substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified hydrolase active sites or substrate binding sites. In one aspect, the method comprises mutagenizing the first nucleic acid of step (a) by a method comprising an optimized directed evolution system, gene site-saturation mutagenesis (GSSM), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR) and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises a hydrolase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing a hydrolase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the hydrolase enzyme, thereby modifying a small molecule by a hydrolase enzymatic reaction. In one aspect, the method can comprise a plurality of small molecule substrates for the enzyme of step (a), thereby generating a library of modified small molecules produced by at least one enzymatic reaction catalyzed by the hydrolase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule which exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of a hydrolase enzyme comprising the steps of: (a) providing a hydrolase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for a hydrolase activity, thereby determining a functional fragment of a hydrolase enzyme. In one aspect, the hydrolase activity is measured by providing a hydrolase substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods of increasing thermotolerance or thermostability of a hydrolase polypeptide, the method comprising glycosylating a hydrolase polypeptide, wherein the polypeptide comprises at least thirty contiguous amino acids of a polypeptide of the invention; or a polypeptide encoded by a nucleic acid sequence of the invention, thereby increasing the thermotolerance or thermostability of the hydrolase polypeptide. In one aspect, the hydrolase specific activity can be thermostable or thermotolerant at a temperature in the range from greater than about 37° C. to about 95° C.

The invention provides methods for overexpressing a recombinant hydrolase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides detergent compositions comprising a polypeptide of the invention or a polypeptide encoded by a nucleic acid of the invention, wherein the polypeptide comprises a hydrolase activity, e.g., an esterase, acylase, lipase, phospholipase or protease activity. In one aspect, the hydrolase can be a nonsurface-active hydrolase. In another aspect, the hydrolase can be a surface-active hydrolase.

The invention provides methods for washing an object comprising the following steps: (a) providing a composition comprising a polypeptide having a hydrolase activity, e.g., an esterase, acylase, lipase, phospholipase or protease activity, wherein the polypeptide comprises: a polypeptide of the invention or a polypeptide encoded by a nucleic acid of the invention; (b) providing an object; and (c) contacting the polypeptide of step (a) and the object of step (b) under conditions wherein the composition can wash the object.

The invention provides methods of making a transgenic plant comprising the following steps: (a) introducing a heterologous nucleic acid sequence into the cell, wherein the heterologous nucleic sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell.

The invention provides signal sequences comprising or consisting of a peptide having a subsequence of a polypeptide of the invention. The invention provides a chimeric protein comprising a first domain comprising a signal sequence of the invention and at least a second domain. The protein can be a fusion protein. The second domain can comprise an enzyme. The enzyme can be a hydrolase.

The invention provides method for biocatalytic synthesis of a structured lipid comprising the following steps: (a) providing a hydrolase of the invention; (b) providing a composition comprising a triacylglyceride (TAG); (c) contacting the polypeptide of step (a) with the composition of step (b) under conditions wherein the polypeptide hydrolyzes an acyl residue at the Sn2 position of the triacylglyceride (TAG), thereby producing a 1,3-diacylglyceride (DAG); (d) providing an R1 ester; (e) providing an R1-specific hydrolase, and (f) contacting the 1,3-DAG of step (c) with the R1 ester of step (d) and the R1-specific hydrolase of step (e) under conditions wherein the R1-specific hydrolase catalyzes esterification of the Sn2 position, thereby producing the structured lipid. The hydrolase can be an Sn2-specific lipase. The structured lipid can comprise a cocoa butter alternative (CBA), a synthetic cocoa butter, a natural cocoa butter, 1,3-dipalmitoyl-2-oleoylglycerol (POP), 1,3-distearoyl-2-oleoylglycerol (SOS), 1-palmitoyl-2-oleoyl-3-stearoylglycerol (POS) or 1-oleoyl-2,3-dimyristoylglycerol (OMM).

The invention provides a method for biocatalytic synthesis of a structured lipid comprising the following steps: (a) providing a hydrolase of the invention; (b) providing a composition comprising a triacylglyceride (TAG); (c) contacting the polypeptide of step (a) with the composition of step (b) under conditions wherein the polypeptide hydrolyzes an acyl residue at the Sn1 or Sn3 position of the triacylglyceride (TAG), thereby producing a 1,2-DAG or 2,3-DAG; and (d) promoting of acyl migration in the 1,2-DAG or 2,3-DAG of the step (c) under kinetically controlled conditions, thereby producing a 1,3-DAG. The method can further comprise providing an R1 ester and an R1-specific lipase, and contacting the 1,3-DAG of step (d) with the R1 ester and the R1-specific lipase under conditions wherein the R1-specific lipase catalyzes esterification of the Sn2 position, thereby producing a structured lipid. The lipase can be an Sn1 or an Sn3-specific lipase. The structured lipid can comprise a cocoa butter alternative (CBA), a synthetic cocoa butter, a natural cocoa butter, 1,3-dipalmitoyl-2-oleoylglycerol (POP), 1,3-distearoyl-2-oleoylglycerol (SOS), 1-palmitoyl-2-oleoyl-3-stearoylglycerol (POS) or 1-oleoyl-2,3-dimyristoylglycerol (OMM). In one aspect of the method, step (d) further comprises using ion exchange resins. The kinetically controlled conditions can comprise non-equilibrium conditions resulting in production of an end product having greater than a 2:1 ratio of 1,3-DAG to 2,3-DAG. The composition of step (b) can comprise a fluorogenic fatty acid (FA). The composition of step (b) can comprise an umbelliferyl FA ester. The end product can be enantiomerically pure.

The invention provides a method for preparation of an optical isomer of a propionic acid from a racemic ester of the propionic acid comprising the following steps: (a) providing a hydrolase of the invention, wherein the hydrolase is stereo-selective for an optical isomer of the propionic acid; (b) providing racemic esters; (c) contacting the polypeptide of step (a) with the racemic esters of step (b) wherein the polypeptide can selectively catalyze the hydrolysis of the esters of step (b), thereby producing the optical isomer of the propionic acid. The optical isomer of the propionic acid can comprise an S(+) of 2-(6-methoxy-2-naphthyl)propionic acid and the racemic esters comprises racemic (R,S) esters of 2-(6-methoxy-2-naphthyl)propionic acid.

The invention provides a method for stereoselectively hydrolyzing racemic mixtures of esters of 2-substituted acids comprising the following steps: (a) providing a hydrolase of the invention, wherein the hydrolase is stereoselective; (b) providing a composition comprising a racemic mixture of esters of 2-substituted acids; and (c) contacting the polypeptide of step (a) with the composition of step (b) under conditions wherein the polypeptide of step (b) can selectively hydrolyze the esters. The hydrolase can be immobilized. The 2-substituted acid can comprise a 2-aryloxy substituted acid, an R-2-(4-hydroxyphenoxy)propionic acid or a 2-arylpropionic acid. The 2-substituted acid can comprise a ketoprofen.

The invention provides a method for oil or fat modification comprising the following steps: (a) providing a hydrolase of the invention; (b) providing an oil or fat, and (c) contacting the hydrolase of step (a) with the oil or fat of step (b) under conditions wherein the hydrolase can modify the oil or fat. The modification can comprise a hydrolase-catalyzed hydrolysis of the fat or oil. The hydrolysis can be a complete or a partial hydrolysis of the fat or oil. The oil can comprise a glycerol ester of a polyunsaturated fatty acid, or a fish, animal, or vegetable oil. The vegetable oil can comprise an olive, canola, sunflower, palm, soy or lauric oil or rice bran oil.

The invention provides a method for hydrolysis of polyunsaturated fatty acid (PUFA) esters comprising the following steps: (a) providing a hydrolase of the invention; (b) providing composition comprising a polyunsaturated fatty acid ester, and (c) contacting the hydrolase with the composition of step (b) under conditions wherein the hydrolase can hydrolyze the polyunsaturated fatty acid (PUFA) ester. The invention provides a method of selective hydrolysis of polyunsaturated fatty acids esters over saturated fatty acid esters comprising the following steps: (a) providing a hydrolase of the invention, wherein the hydrolase has a lipase activity and selectively hydrolyzes polyunsaturated fatty acid (PUFA) esters; (b) providing a composition comprising a mixture of polyunsaturated and saturated esters; and (c) contacting the polypeptide of step (a) with the composition of step (b) under conditions wherein the polypeptide can selectively catalyze the hydrolysis of polyunsaturated fatty acids esters.

The invention provides a method for preparing a food or a feed additive comprising polyunsaturated fatty acids (PUFA) comprising the following steps: (a) providing a hydrolase of the invention, wherein the hydrolase selectively hydrolyzes polyunsaturated fatty acid (PUFA) esters; (b) providing a composition comprising a PUFA ester; and (c) contacting the polypeptide of step (a) with the composition of step (b) under conditions wherein the polypeptide can selectively catalyze the hydrolysis of polyunsaturated fatty acid esters thereby producing the PUFA-containing food or feed additive.

The invention provides a method for treatment of latex comprising the following steps: (a) providing a hydrolase of the invention, wherein the polypeptide has selectivity for a saturated ester over an unsaturated ester, thereby converting the saturated ester to its corresponding acid and alcohol; (b) providing a latex composition comprising saturated and unsaturated esters; (c) contacting the hydrolase of step (a) with the composition of step (b) under conditions wherein the polypeptide can selectively hydrolyze saturated esters, thereby treating the latex. The ethyl propionate can be selectively hydrolyzed over ethyl acrylate. The latex composition of step (b) can comprise polymers containing acrylic, vinyl and unsaturated acid monomers, alkyl acrylate monomers, methyl acrylate, ethyl acrylate, propyl acrylate and butyl acrylate, acrylate acids, acrylic acid, methacrylic acid, crotonic acid, itaconic acid and mixtures thereof. The latex composition can be a hair fixative. The conditions of step (c) can comprise a pH in the range from about pH 4 to pH 8 and a temperature in the range from about 20° to about 50° C.

The invention provides a method for refining a lubricant comprising the following steps: (a) providing a composition comprising a hydrolase of the invention; (b) providing a lubricant; and (c) treating the lubricant with the hydrolase under conditions wherein the hydrolase can selective hydrolyze oils in the lubricant, thereby refining it. The lubricant can be a hydraulic oil.

The invention provides a method of treating a fabric comprising the following steps: (a) providing a composition comprising a hydrolase of the invention, wherein the hydrolase can selectively hydrolyze carboxylic esters; (b) providing a fabric; and (c) treating the fabric with the hydrolase under condition wherein the hydrolase can selectively hydrolyze carboxylic esters thereby treating the fabric. The treatment of the fabric can comprise improvement of the hand and drape of the final fabric, dyeing, obtaining flame retardancy, obtaining water repellency, obtaining optical brightness, or obtaining resin finishing. The fabric can comprise cotton, viscose, rayon, lyocell, flax, linen, ramie, all blends thereof, or blends thereof with polyesters, wool, polyamides acrylics or polyacrylics. The invention provides a fabric, yarn or fiber comprising a hydrolase of the invention, which can be adsorbed, absorbed or immobilized on the surface of the fabric, yarn or fiber.

The invention provides a method for removing or decreasing the amount of a food or oil stain comprising contacting a hydrolase of the invention with the food or oil stain under conditions wherein the hydrolase can hydrolyze oil or fat in the stain. The hydrolase can have an enhanced stability to denaturation by surfactants and to heat deactivation. The hydrolase can have a detergent or a laundry solution.

The invention provides a dietary composition comprising a hydrolase of the invention. The dietary composition can further comprise a nutritional base comprising a fat. The hydrolase can be activated by a bile salt. The dietary composition can further comprising a cow's milk-based infant formula. The hydrolase can hydrolyze long chain fatty acids. The invention provides a method of reducing fat content in milk or vegetable-based dietary compositions comprising the following steps: (a) providing a composition comprising a hydrolase of the invention; (b) providing a composition comprising a milk or a vegetable oil, and (c) treating the composition of step (b) with the hydrolase under conditions wherein the hydrolase can hydrolyze the oil or fat in the composition, thereby reducing its fat content. The invention provides a dietary composition for a human or non-ruminant animals comprising a nutritional base, wherein the base comprises a fat and no or little hydrolase, and an effective amount of a hydrolase to increase fat absorption and growth of human or non-ruminant animal.

The invention provides a method of catalyzing an interesterification reaction to produce new triglycerides comprising the following steps: (a) providing a composition comprising a hydrolase of the invention, wherein the hydrolase can catalyze an interesterification reaction; (b) providing a mixture of triglycerides and free fatty acids; (c) treating the composition of step (b) with the hydrolase under conditions wherein the hydrolase can catalyze exchange of free fatty acids with the acyl groups of triglycerides, thereby producing new triglycerides enriched in the added fatty acids. The hydrolase can be an Sn1,3-specific lipase. The invention provides a transesterification method for preparing a margarine oil having a low trans-acid and a low intermediate chain fatty acid content, comprising the following steps: (a) providing a transesterification reaction mixture comprising a stearic acid source material selected from the group consisting of stearic acid, stearic acid monoesters of low molecular weight monohydric alcohols and mixtures thereof, (b) providing a liquid vegetable oil; (c) providing a hydrolase of the invention, wherein the polypeptide comprises a 1,3-specific lipase activity; (d) transesterifying the stearic acid source material and the vegetable oil triglyceride, to substantially equilibrate the ester groups in the 1-, 3-positions of the glyceride component with non-glyceride fatty acid components of the reaction mixture, (e) separating transesterified free fatty acid components from glyceride components of the transesterification mixture to provide a transesterified margarine oil product and a fatty acid mixture comprising fatty acids, fatty acid monoesters or mixtures thereof released from the vegetable oil, and (f) hydrogenating the fatty acid mixture.

The invention provides a method for making a composition comprising 1-palmitoyl-3-stearoyl-2-monoleine (POSt) and 1,3-distearoyl-2-monoleine (StOSt) comprising providing a lipase, wherein the lipase is capable of 1,3-specific lipase-catalyzed interesterification of 1,3-dipalmitoyl-2-monoleine (POP) with stearic acid or tristearin, to make a product enriched in the 1-palmitoyl-3-stearoyl-2-monoleine (POSt) or 1,3-distearoyl-2-monoleine (StOSt).

The invention provides a method for ameliorating or preventing lipopolysaccharide (LPS)-mediated toxicity comprising administering to a patient a pharmaceutical composition comprising a polypeptide of the invention. The invention provides a method for detoxifying an endotoxin comprising contacting the endotoxin with a polypeptide of the invention. The invention provides a method for deacylating a 2' or a 3' fatty acid chain from a lipid A comprising contacting the lipid A with a polypeptide of the invention.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

DESCRIPTION OF DRAWINGS

The following drawings are illustrative of embodiments of the invention and are not meant to limit the scope of the invention as encompassed by the claims.

The patent or application file contains at least one drawing executed in color. Copies of this patent or patent application publication with color drawing(s) will be provided by the Office upon request and payment of the necessary fee.

FIG. 30 is a chart describing selected characteristics of exemplary nucleic acids and polypeptides of the invention, as described in further detail, below.

Like reference symbols in the various drawings indicate like elements.

DETAILED DESCRIPTION

In one aspect, the invention provides hydrolases, polynucleotides encoding them, and methods of making and using these polynucleotides and polypeptides. In one aspect, the invention is directed to polypeptides, e.g., enzymes, having a hydrolase activity, e.g., an esterase, acylase, lipase, phospholipase or protease activity, including thermostable and thermotolerant hydrolase activity, and polynucleotides encoding these enzymes, and making and using these polynucleotides and polypeptides. The hydrolase activities of the polypeptides and peptides of the invention include esterase activity, lipase activity (hydrolysis of lipids), acidolysis reactions (to replace an esterified fatty acid with a free fatty acid), transesterification reactions (exchange of fatty acids between triglycerides), ester synthesis, ester interchange reactions, phospholipase activity (e.g., phospholipase A, B, C and D activity, patatin activity, lipid acyl hydrolase (LAH) activity) and protease activity (hydrolysis of peptide bonds). The polypeptides of the invention can be used in a variety of pharmaceutical, agricultural and industrial contexts, including the manufacture of cosmetics and nutraceuticals. In another aspect, the polypeptides of the invention are used to synthesize enantiomerically pure chiral products. The polypeptides of the invention can be used in a variety of pharmaceutical, agricultural and industrial contexts, including the manufacture of cosmetics and nutraceuticals.

Enzymes of the invention can be highly selective catalysts. They can have the ability to catalyze reactions with stereo-, regio-, and chemo-selectivities not possible in conventional synthetic chemistry. Enzymes of the invention can be versatile. In various aspects, they can function in organic solvents, operate at extreme pHs (for example, high pHs and low pHs) extreme temperatures (for example, high temperatures and low temperatures), extreme salinity levels (for example, high salinity and low salinity), and catalyze reactions with compounds that are structurally unrelated to their natural, physiological substrates.

Hydrolases of the Invention Having Lipase Activity

In one aspect, the polypeptides of the invention have lipase activity and can be used as lipases, e.g., in the biocatalytic synthesis of structured lipids (lipids that contain a defined set of fatty acids distributed in a defined manner on the glycerol backbone), including cocoa butter alternatives, poly-unsaturated fatty acids (PUFAs), 1,3-diacyl glycerides (DAGs), 2-monoglycerides (MAGs) and triacylglycerides (TAGs), such as 1,3-dipalmitoyl-2-oleoylglycerol (POP), 1,3-distearoyl-2-oleoylglycerol (SOS), 1-palmitoyl-2-oleyl-3-stearoylglycerol POS) or 1-oleoyl-2,3-dimyristoylglycerol (OMM), long chain polyunsaturated fatty acids such as arachidonic acid, docosahexaenoic acid (DHA) and eicosapentaenoic acid (EPA).

Figure 28:
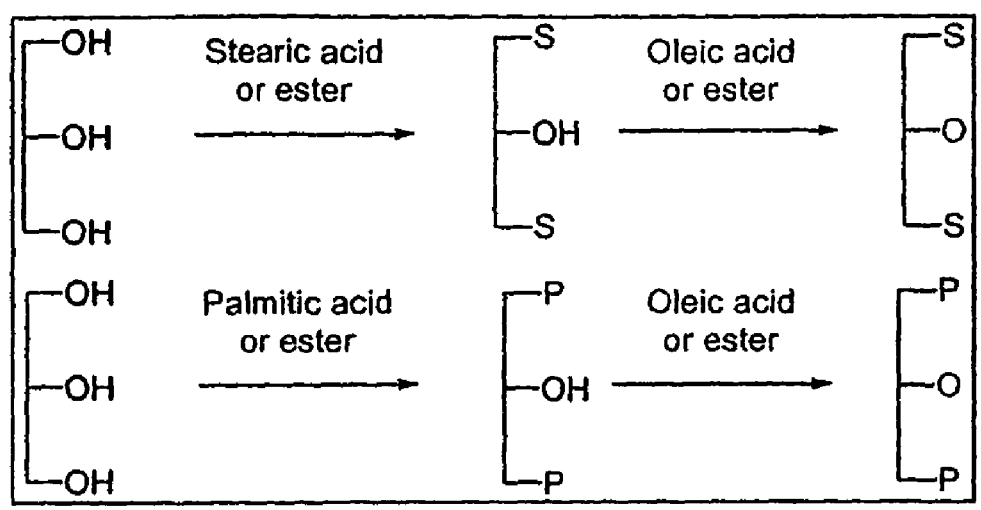
FIG. 28 illustrates an exemplary synthesis of a triglyceride mixture composed of POS (Palmitic-Oleic-Stearic), POP (Palmitic-Oleic-Palmitic) and SOS (Stearic-Oleic-Stearic) from glycerol, as discussed below.
Figure 29:
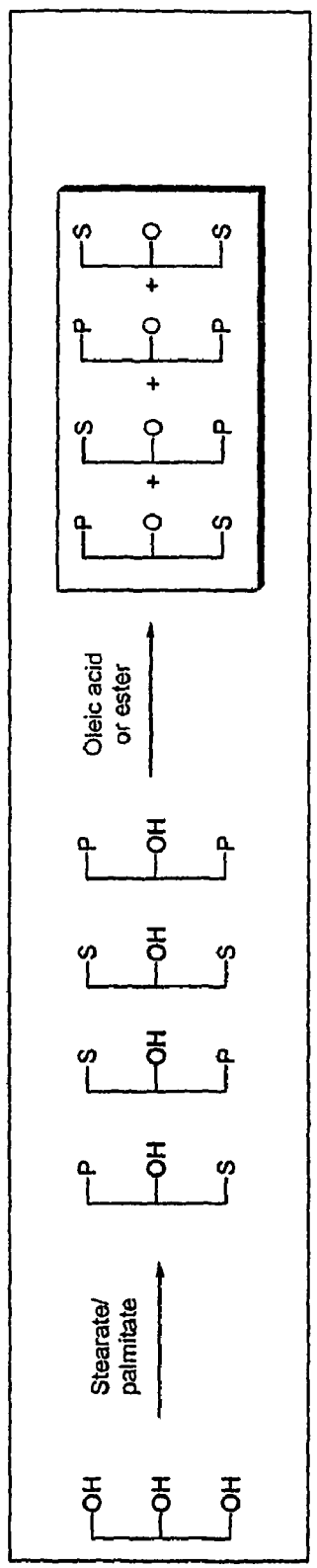
FIG. 29 illustrates an exemplary synthesis where stearate and palmitate are mixed together to generate mixtures of DAGs which are subsequently acylated with oleate to give components of cocoa butter equivalents, as discussed below.

In one aspect, the invention provides an exemplary synthesis (using lipases of the invention) of a triglyceride mixture composed of POS (Palmitic-Oleic-Stearic), POP (Palmitic-Oleic-Palmitic) and SOS (Stearic-Oleic-Stearic) from glycerol, as illustrated in FIG. 28. This exemplary synthesis uses free fatty acids versus fatty acid esters. In one aspect, this reaction can be performed in one pot with sequential addition of fatty acids using crude glycerol and free fatty acids and fatty acid esters. In one aspect, stearate and palmitate are mixed together to generate mixtures of DAGs. In one aspect, the diacylglycerides are subsequently acylated with oleate to give components of cocoa butter equivalents, as illustrated in FIG. 29. In alternative aspects, the proportions of POS, POP and SOS can be varied according to: stearate to palmitate ratio; selectivity of enzyme for palmitate versus stearate; or enzyme enantioselectivity (could alter levels of POS/SOP). One-pot synthesis of cocoa butter equivalents or other cocoa butter alternatives is possible using this aspect of the invention.

Figure 6:
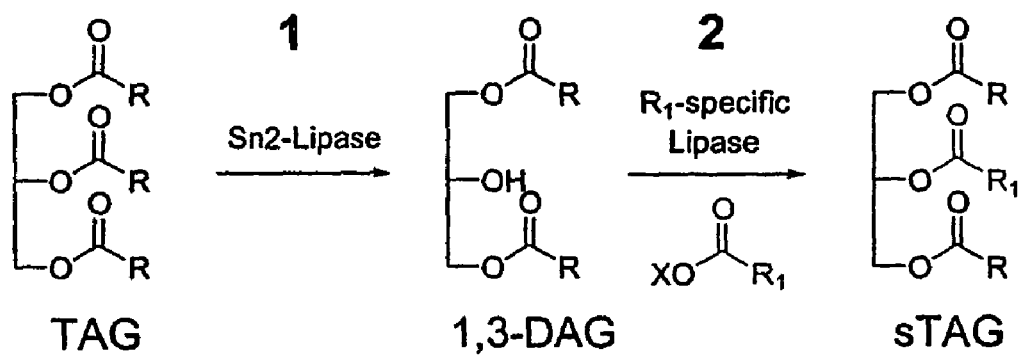
FIG. 6 illustrates an exemplary method of the invention using an Sn2 regio-specific lipase in the synthesis of structured lipids.

In one aspect, lipases that exhibit regioselectivity and/or chemoselectivity are used in the structure synthesis of lipids or in the processing of lipids. Thus, the methods of the invention use lipases with defined regio-specificity or defined chemoselectivity (e.g., a fatty acid specificity) in a biocatalytic synthetic reaction. For example, the methods of the invention can use lipases with SN1, SN2 and/or SN3 regiospecificity, or combinations thereof. In one aspect, the methods of the invention use lipases that exhibit regioselectivity for the 2-position of a triacylglyceride (TAG). This SN2 regioselectivity can be used in the synthesis of a variety of structured lipids, e.g., triacylglycerides (TAGs), including 1,3-DAGs and components of cocoa butter, as illustrated in FIG. 6.

The methods and compositions (lipases) of the invention can be used in the biocatalytic synthesis of structured lipids, and the production of nutraceuticals (e.g., polyunsaturated fatty acids and oils), various foods and food additives (e.g., emulsifiers, fat replacers, margarines and spreads), cosmetics (e.g., emulsifiers, creams), pharmaceuticals and drug delivery agents (e.g., liposomes, tablets, formulations), and animal feed additives (e.g., polyunsaturated fatty acids, such as linoleic acids) comprising lipids made by the structured synthesis methods of the invention or processed by the methods of the invention In one aspect, lipases of the invention can act on fluorogenic fatty acid (FA) esters, e.g., umbelliferyl FA esters. In one aspect, profiles of FA specificities of lipases made or modified by the methods of the invention can be obtained by measuring their relative activities on a series of umbelliferyl FA esters, such as palmitate, stearate, oleate, laurate, PUFA, butyrate. The following table 1 indicates activity for some exemplary lipases of the invention. The activity was tested on butyrate and oleate.

TABLE 1

Activity for exemplary lipases with umbelliferyl FA esters

| SEQ ID NO: | Specific Activity | Specific Activity Units | Substrate | Substrate Concentration | Substrate Concentration Units |
|---|---|---|---|---|---|
| 69, 70 | 2713.1 | U/mg | Muf-Butyrate | 1 | mM |
| 67, 68 | 51.1 | U/mg | Muf-Oleate | 1 | mM |

TABLE 1-continued

Activity for exemplary lipases with umbelliferyl FA esters

| SEQ ID NO: | Specific Activity | Specific Activity Units | Substrate | Substrate Concentration | Substrate Concentration Units |
|---|---|---|---|---|---|
| 67, 68 | 5451.2 | U/mg | Muf-Butyrate | 1 | mM |
| 99, 100 | 2441 | U/mg | Muf-Butyrate | 1 | mM |
| 99, 100 | 13 | U/mg | Muf-Oleate | 1 | mM |
| 15, 16 | 1847.7 | U/mg | Muf-Butyrate | 1 | mM |
| 15, 16 | 43.2 | U/mg | Muf-Oleate | 1 | mM |
| 39, 40 | 11560.8 | U/mg | Muf-Butyrate | 1 | mM |
| 39, 40 | 1601.2 | U/mg | Muf-Oleate | 1 | mM |
| 75, 76 | 25842.6 | U/mg | Muf-Butyrate | 1 | mM |
| 75, 76 | 3.7 | U/mg | Muf-Oleate | 1 | mM |
| 33, 34 | 28769.7 | U/mg | Muf-Butyrate | 1 | mM |
| 33, 34 | 4.6 | U/mg | Muf-Oleate | 1 | mM |
| 25, 26 | 8.9 | U/mg | Muf-Oleate | 1 | mM |
| 25, 26 | 49382.7 | U/mg | Muf-Butyrate | 1 | mM |
| 3, 4 | 1193.1 | U/mg | Muf-Butyrate | 1 | mM |
| 3, 4 | 97 | U/mg | Muf-Oleate | 1 | mM |
| 113, 114 | 0.12 | U/mg | Muf-Oleate | 1 | mM |
| 113, 114 | 95.5 | U/mg | Muf-Butyrate | 1 | mM |

The methods and compositions (lipases) of the invention can be used to synthesize enantiomerically pure chiral products. In one aspect, the methods and compositions (lipases) of the invention can be used to prepare a D-amino acid and corresponding esters from a racemic mix. For example, D-aspartic acid can be prepared from racemic aspartic acid. In one aspect, optically active D-homophenylalanine and/or its esters are prepared. The enantioselectively synthesized D-homophenylalanine can be starting material for many drugs, such as Enalapril, Lisinopril, and Quinapril, used in the treatment of hypertension and congestive heart failure. The D-aspartic acid and its derivatives made by the methods and compositions of the invention can be used in pharmaceuticals, e.g., for the inhibition of arginiosuccinate synthetase to prevent or treat sepsis or cytokine-induced systemic hypotension or as immunosuppressive agents. The D-aspartic acid and its derivatives made by the methods and compositions of the invention can be used as taste modifying compositions for foods, e.g., as sweeteners (e.g., ALITAME™). For example, the methods and compositions (lipases) of the invention can be used to synthesize an optical isomer S(+) of 2-(6-methoxy-2-naphthyl)propionic acid from a racemic (R,S) ester of 2-(6-methoxy-2-naphthyl)propionic acid (see, e.g., U.S. Pat. No. 5,229,280).

In one aspect, the methods and compositions (lipases) of the invention can be used to for stereoselectively hydrolyzing racemic mixtures of esters of 2-substituted acids, e.g., 2-aryloxy substituted acids, such as R-2-(4-hydroxyphenoxy)propionic acid, 2-arylpropionic acid, ketoprofen to synthesize enantiomerically pure chiral products. See, e.g., U.S. Pat. No. 5,108,916.

In one aspect, the lipase of the invention for these reactions is immobilized, e.g., as described below. In alternative aspects, the methods of the invention do not require an organic solvent, can proceed with relatively fast reaction rates; and do not require a protective group for the amino acid. See, e.g., U.S. Pat. Nos. 5,552,317; 5,834,259.

The methods and compositions (lipases) of the invention can be used to hydrolyze oils, such as fish, animal and vegetable oils, and lipids, such as poly-unsaturated fatty acids. In one aspect, the polypeptides of the invention are used process fatty acids (such as poly-unsaturated fatty acids), e.g., fish oil fatty acids, for use in or as a feed additive. Addition of poly-unsaturated fatty acids PUFAs to feed for dairy cattle has been demonstrated to result in improved fertility and milk yields. Fish oil contains a high level of PUFAs (see Table 2, below) and therefore is a potentially inexpensive source for PUFAs as a starting material for the methods of the invention. The biocatalytic methods of the invention can process fish oil under mild conditions, thus avoiding harsh conditions utilized in some processes. Harsh conditions may promote unwanted isomerization, polymerization and oxidation of the PUFAs. In one aspect, the methods of the invention comprise lipase-catalyzed total hydrolysis of fish-oil or selective hydrolysis of PUFAs from fish oil to provide a mild alternative that would leave the high-value PUFAs intact. In one aspect, the methods further comprise hydrolysis of lipids by chemical or physical splitting of the fat.

TABLE 2

Fatty acid composition of a variety of fats and oils.
Fatty acid content of fats (%):

| | 14:0 | 16:0 | 16:1 | 18:0 | 18:1 | 18:2 | 18:3 | 18:4 | 20:x | 22:x |
|---|---|---|---|---|---|---|---|---|---|---|
| Tallow | 3.7 | 24.9 | 4.2 | 18.9 | 36 | 3.1 | | | | |
| Lard | | 23.8 | 2.7 | 13.5 | 41.2 | 10.2 | 1.0 | | | |
| Canola Oil | | 4.0 | | 1.8 | 56.1 | 20.3 | 9.3 | | 2.4 | 1.0 |
| Soybean Oil | | 10.3 | | 3.8 | 22.8 | 51 | 6.8 | | 0.2 | |
| Palm Oil | | 48.6 | | 4.1 | 36.6 | 9.1 | 0.3 | | 0.1 | |
| Corn Oil | | 10.9 | | 1.8 | 24.2 | 58 | 0.7 | | | |
| Fish Oil | 7.2 | 16.7 | 11.1 | 3.2 | 10.2 | 1.4 | 2.4 | 3.5 | 16.4 | 16.1 |

Figure 10:
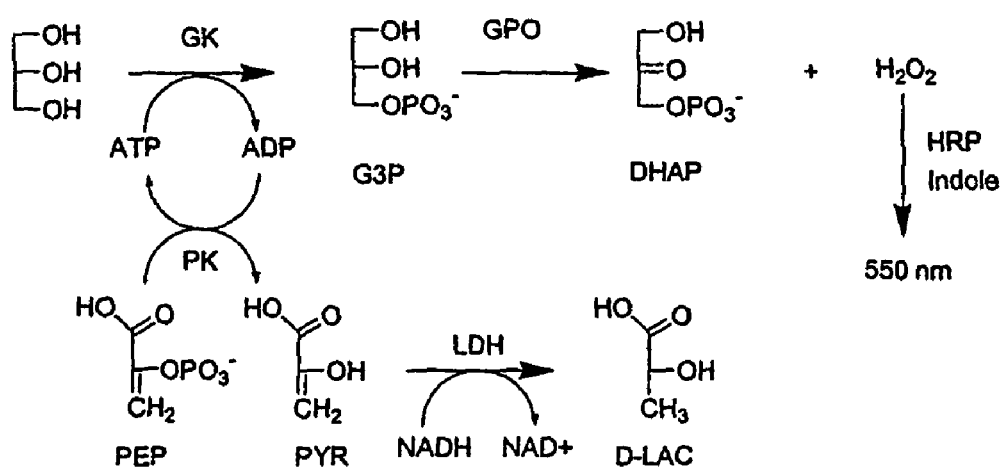
FIG. 10 illustrates an exemplary method comprising a coupled enzyme assay, as discussed in detail, below.

In one aspect, the lipases and methods of the invention are used for the total hydrolysis of fish oil. Lipases can be screened for their ability to catalyze the total hydrolysis of fish oil under different conditions using, e.g., a method comprising a coupled enzyme assay, as illustrated in FIG. 10, to detect the release of glycerol from lipids. This assay has been validated in the presence of lipid emulsions and retains sensitivity under these conditions. In alternative aspects, a single or multiple lipases are used to catalyze the total splitting of the fish oil. Several lipases of the invention may need to be used, owing to the presence of the PUFAs. In one aspect, a PUFA-specific lipase of the invention is combined with a general lipase to achieve the desired effect.

The methods and compositions (lipases) of the invention can be used to catalyze the partial or total hydrolysis of other oils, e.g. olive oils, that do not contain PUFAs.

The methods and compositions (lipases) of the invention can be used to catalyze the hydrolysis of PUFA glycerol esters. These methods can be used to make feed additives. In one aspect, lipases of the invention catalyze the release of PUFAs from simple esters and fish oil. Standard assays and analytical methods can be utilized.

The methods and compositions (lipases) of the invention can be used to selectively hydrolyze saturated esters over unsaturated esters into acids or alcohols. The methods and compositions (lipases) of the invention can be used to treat latexes for a variety of purposes, e.g., to treat latexes used in hair fixative compositions to remove unpleasant odors. The methods and compositions (lipases) of the invention can be used in the treatment of a lipase deficiency in an animal, e.g., a mammal, such as a human. The methods and compositions (lipases) of the invention can be used to prepare lubricants, such as hydraulic oils. The methods and compositions (lipases) of the invention can be used in making and using detergents. The methods and compositions (lipases) of the invention can be used in processes for the chemical finishing of fabrics, fibers or yarns. In one aspect, the methods and compositions (lipases) of the invention can be used for obtaining flame retardancy in a fabric using, e.g., a halogen-substituted carboxylic acid or an ester thereof, i.e. a fluorinated, chlorinated or bromated carboxylic acid or an ester thereof. In one aspect, the invention provides methods of generating lipases from environmental libraries.

Hydrolases of the Invention Having Esterase or Acylase Activity

In one aspect, the hydrolase activity of the invention comprises an acylase or an esterase activity. In one aspect, the hydrolysis activity comprises hydrolyzing a lactone ring or acylating an acyl lactone or a diol lactone. In one aspect, the hydrolysis activity comprises an esterase activity. In one aspect, the esterase activity comprises hydrolysis of ester groups to organic acids and alcohols. In one aspect, the esterase activity comprises feruloyl esterase activity. In one aspect, the esterase activity comprises a lipase activity. In alternative aspects, the esterase activities of the enzymes of the invention include lipase activity (in the hydrolysis of lipids), acidolysis reactions (to replace an esterified fatty acid with a free fatty acid), transesterification reactions (exchange of fatty acids between triglycerides), ester synthesis and ester interchange reactions. The enzymes of the invention can also be utilized in organic synthesis reactions in the manufacture of medicaments, pesticides or intermediates thereof.

In one aspect, the polypeptides of the invention have esterase or acylase activity and can be used, e.g., to hydrolyze a lactone ring or acylate an acyl lactone or a diol lactone. In one aspect, the hydrolysis activity of a polypeptide of the invention comprises an esterase activity. In one aspect, the esterase activity comprises hydrolysis of ester groups to organic acids and alcohols. In one aspect, the esterase activity comprises feruloyl esterase activity. In one aspect, the esterase activity comprises a lipase activity. In alternative aspects, the esterase activities of the enzymes of the invention include lipase activity (in the hydrolysis of lipids), acidolysis reactions (to replace an esterified fatty acid with a free fatty acid), transesterification reactions (exchange of fatty acids between triglycerides), ester synthesis and ester interchange reactions. The enzymes of the invention can also be utilized in organic synthesis reactions in the manufacture of medicaments, pesticides or intermediates thereof. The esterase activities of the polypeptides and peptides of the invention include lipase activity (in the hydrolysis of lipids), acidolysis reactions (to replace an esterified fatty acid with a free fatty acid), transesterification reactions (exchange of fatty acids between triglycerides), ester synthesis and ester interchange reactions. The polypeptides and peptides of the invention can also be utilized in organic synthesis reactions in the manufacture of medicaments, pesticides or intermediates thereof.

Hydrolases of the Invention Having Protease Activity

In one aspect, the invention provides polypeptides having a protease activity, polynucleotides encoding the polypeptides, and methods for making and using these polynucleotides and polypeptides. In one aspect, the proteases of the invention are used to catalyze the hydrolysis of peptide bonds. The proteases of the invention can be used to make and/or process foods or feeds, textiles, detergents and the like. The proteases of the invention can be used in pharmaceutical compositions and dietary aids.

The protease preparations of the invention (including those for treating or processing feeds or foods, treating fibers and textiles, waste treatments, plant treatments, and the like) can further comprise one or more enzymes, for example, pectate lyases, cellulases (endo-beta-1,4-glucanases), beta-glucanases (endo-beta-1,3 (4)-glucanases), lipases, cutinases, peroxidases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases, transglutaminases; or mixtures thereof.

A polypeptide can be routinely assayed for protease activity (e.g., tested to see if the protein is within the scope of the invention) by any method, e.g., protease activity can be assayed by the hydrolysis of casein in zymograms, the release of fluorescence from gelatin, or the release of p-nitroanalide from various small peptide substrates (these and other exemplary protease assays are set forth in the Examples, below).

Hydrolases of the Invention Having Phospholipase Activity

In one aspect, the invention provides polypeptides having a phospholipase activity. The phospholipases of the invention can have phospholipase A, B, C, D, a lipid acyl hydrolase (LAH), or patatin enzyme activity. The phospholipases of the invention can efficiently cleave glycerolphosphate ester linkage in oils, such as vegetable oils, e.g., oilseed phospholipids, to generate a water extractable phosphorylated base and a diglyceride. In alternative aspects, the phospholipases of the invention can cleave glycerolphosphate ester linkages in phosphatidylcholine, phosphatidylethanolamine, phosphatidylserine and sphingomyelin.

In one aspect, the phospholipases of the invention are used in various vegetable oil processing steps, such as in vegetable oil extraction, particularly, in the removal of "phospholipid gums" in a process called "oil degumming," as described herein. The production of vegetable oils from various sources, such as rice bran, soybeans, rapeseed, peanut, sesame, sunflower and corn. The phospholipase enzymes of the invention can be used in place of PLA, e.g., phospholipase A2, in any vegetable oil processing step. A phospholipase of the invention (e.g., phospholipase A, B, C, D, patatin enzymes) can be used for enzymatic degumming of vegetable oils because the phosphate moiety is soluble in water and easy to remove. The diglyceride product will remain in the oil and therefore will reduce losses. The PLCs of the invention can be used in addition to or in place of PLA1s and PLA2s in commercial oil degumming, such as in the ENZYMAX® process, where phospholipids are hydrolyzed by PLA1 and PLA2.

In alternative aspects, enzymes of the invention have phosphatidylinositol-specific phospholipase C (PI-PLC) activity, phosphatidylcholine-specific phospholipase C activity, phosphatidic acid phosphatase activity, phospholipase A activity and/or patatin-related phospholipase activity. These enzymes can be used alone or in combination each other or with other enzymes of the invention, or other enzymes. In one aspect, the invention provides methods wherein these enzymes (including phosphatidylinositol-specific phospholipase C, phosphatidylcholine-specific phospholipase C, phosphatidic acid phosphatase, phospholipase A and/or patatin-related phospholipases of the invention) are used alone or in combination in the degumming of oils, e.g., rice bran oil, vegetable oils, e.g., high phosphorous oils, such as soybean, corn, canola and sunflower oils.

These enzymes and processes of the invention can be used to achieve a more complete degumming of high phosphorous oils, in particular, rice bran, soybean, corn, canola, and sunflower oils. Upon cleavage by PI-PLC, phosphatidylinositol is converted to diacylglycerol and phosphoinositol. The diacylglycerol partitions to the aqueous phase (improving oil yield) and the phosphoinositol partitions to the aqueous phase where it is removed as a component of the heavy phase during centrifugation. An enzyme of the invention, e.g., a PI-PLC of the invention, can be incorporated into either a chemical or physical oil refining process.

In one aspect, hydrolases, e.g., PLC phospholipases, of the invention utilize a variety of phospholipid substrates including phosphatidylcholine, phosphatidylethanolamine, phosphatidylserine, phosphatidylinositol, and phosphatidic acid. In addition, these enzymes can have varying degrees of activity on the lysophospholipid forms of these phospholipids. In various aspects, PLC enzymes of the invention may show a preference for phosphatidylcholine and phosphatidylethanolamine as substrates.

In one aspect, hydrolases, e.g., phosphatidylinositol PLC phospholipases, of the invention utilize a variety of phospholipid substrates including phosphatidylcholine, phosphatidylethanolamine, phosphatidylserine, phosphatidylinositol, and phosphatidic acid. In addition, these enzymes can have varying degrees of activity on the lysophospholipid forms of these phospholipids. In various aspects, phosphatidylinositol PLC enzymes of the invention may show a preference for phosphatidylinositol as a substrate.

In one aspect, hydrolases, e.g., patatin enzymes, of the invention utilize a variety of phospholipid substrates including phosphatidylcholine, phosphatidylethanolamine, phosphatidylserine, phosphatidylinositol, and phosphatidic acid. In addition, these enzymes can have varying degrees of activity on the lysophospholipid forms of these phospholipids. In various aspects, patatins of the invention are based on a conservation of amino acid sequence similarity. In various aspects, these enzymes display a diverse set of biochemical properties and may perform reactions characteristic of PLA1, PLA2, PLC, or PLD enzyme classes.

In one aspect, hydrolases, e.g., PLD phospholipases, of the invention utilize a variety of phospholipid substrates including phosphatidylcholine, phosphatidylethanolamine, phosphatidylserine, phosphatidylinositol, and phosphatidic acid. In addition, these enzymes can have varying degrees of activity on the lysophospholipid forms of these phospholipids. In one aspect, these enzymes are useful for carrying out transesterification reactions to produce structured phospholipids.

Definitions

As used herein, the term "hydrolase" encompasses polypeptides (e.g., antibodies, enzymes) and peptides (e.g., "active sites") having any hydrolase activity, i.e., the polypeptides of the invention can have any hydrolase activity, including lipase, esterase, phospholipase and/or protease activity.

The term "lipase" includes all polypeptides having any lipase activity, including lipid synthesis or lipid hydrolysis activity, i.e., the polypeptides of the invention can have any lipase activity. Lipases of the invention include enzymes active in the bioconversion of lipids through catalysis of hydrolysis, alcoholysis, acidolysis, esterification and aminolysis reactions. In one aspect, lipases of the invention can hydrolyze lipid emulsions. In one aspect, enzymes of the invention can act preferentially on sn-1 and/or sn-3 bonds of triglycerides to release fatty acids from the glycerol backbone. For example, lipase activity of the polypeptides of the invention include synthesis of cocoa butter, poly-unsaturated fatty acids (PUFAs), 1,3-diacyl glycerides (DAGs), 2-monoglycerides (MAGs) and triacylglycerides (TAGs). The term also includes lipases capable of isomerizing bonds at high temperatures, low temperatures, alkaline pHs and at acidic pHs.

The term "phospholipase" encompasses enzymes having any phospholipase activity, i.e., the polypeptides of the invention can have any phospholipase activity. For example, a phospholipase activity of the invention can comprise cleaving a glycerolphosphate ester linkage (catalyzing hydrolysis of a glycerolphosphate ester linkage), e.g., in an oil, such as a vegetable oil. A phospholipase activity of the invention can generate a water extractable phosphorylated base and a diglyceride. A phospholipase activity of the invention also includes hydrolysis of glycerolphosphate ester linkages at high temperatures, low temperatures, alkaline pHs and at acidic pHs. The term "a phospholipase activity" also includes cleaving a glycerolphosphate ester to generate a water extractable phosphorylated base and a diglyceride. The term "a phospholipase activity" also includes cutting ester bonds of glycerin and phosphoric acid in phospholipids. The term "a phospholipase activity" also includes other activities, such as the ability to bind to a substrate, such as an oil, e.g. a vegetable oil, substrate also including plant and animal phosphatidylcholines, phosphatidyl-ethanolamines, phosphatidylserines and sphingomyelins. The phospholipase activity can comprise a phospholipase C (PLC) activity, a phospholipase A (PLA) activity, such as a phospholipase A1 or phospholipase A2 activity, a phospholipase B (PLB) activity, such as a phospholipase B1 or phospholipase B2 activity, a phospholipase D (PLD) activity, such as a phospholipase D1 or a phospholipase D2 activity. The phospholipase activity can comprise hydrolysis of a glycoprotein, e.g., as a glycoprotein found in a potato tuber or any plant of the genus Solanum, e.g., Solanum tuberosum. The phospholipase activity can comprise a patatin enzymatic activity, such as a patatin esterase activity (see, e.g., Jimenez (2002) Biotechnol. Prog. 18:635-640). The phospholipase activity can comprise a lipid acyl hydrolase (LAH) activity.

The term "protease" includes all polypeptides having a protease activity, including a peptidase and/or a proteinase activity; i.e., the polypeptides of the invention can have any protease activity. A protease activity of the invention can comprise catalysis of the hydrolysis of peptide bonds. The proteases of the invention can catalyze peptide hydrolysis reactions in both directions. The direction of the reaction can be determined, e.g., by manipulating substrate and/or product concentrations, temperature, selection of protease and the like. The protease activity can comprise an endoprotease activity and/or an exoprotease activity. The protease activity can comprise a protease activity, e.g., a carboxypeptidase activity, a dipeptidylpeptidase or an aminopeptidase activity, a serine protease activity, a metalloproteinase activity, a cysteine protease activity and/or an aspartic protease activity. In one aspect, protease activity can comprise activity the same or similar to a chymotrypsin, a trypsin, an elastase, a kallikrein and/or a subtilisin activity.

The term esterase includes all polypeptides having an esterase activity, i.e., the polypeptides of the invention can have any esterase activity. For example, the invention provides polypeptides capable of hydrolyzing ester groups to organic acids and alcohols. The term "esterase" also encompasses polypeptides having lipase activity (in the hydrolysis of lipids), acidolysis reactions (to replace an esterified fatty acid with a free fatty acid), trans-esterification reactions (exchange of fatty acids between triglycerides), ester synthesis and ester interchange reactions. In one aspect, the hydrolases of the invention can hydrolyze a lactone ring or acylate an acyl lactone or a diol lactone. The polypeptides of the invention can be enantiospecific, e.g., as when used in chemoenzymatic reactions in the synthesis of medicaments and insecticides. The polynucleotides of the invention encode polypeptides having esterase activity.

A hydrolase variant (e.g., "lipase variant", "esterase variant", "protease variant" "phospholipase variant") can have an amino acid sequence which is derived from the amino acid sequence of a "precursor". The precursor can include naturally-occurring hydrolase and/or a recombinant hydrolase. The amino acid sequence of the hydrolase variant is "derived" from the precursor hydrolase amino acid sequence by the substitution, deletion or insertion of one or more amino acids of the precursor amino acid sequence. Such modification is of the "precursor DNA sequence" which encodes the amino acid sequence of the precursor lipase rather than manipulation of the precursor hydrolase enzyme per se. Suitable methods for such manipulation of the precursor DNA sequence include methods disclosed herein, as well as methods known to those skilled in the art.

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody." Thus, the invention provides antibodies, including antigen binding sites and single chain antibodies that specifically bind to a hydrolase of the invention. In practicing the methods of the invention, polypeptides having a hydrolase activity can also be used.

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

As used herein, the terms "computer," "computer program" and "processor" are used in their broadest general contexts and incorporate all such devices, as described in detail, below.

A "coding sequence of" or a "sequence encodes" a particular polypeptide or protein, is a nucleic acid sequence which is transcribed and translated into a polypeptide or protein when placed under the control of appropriate regulatory sequences.

The term "expression cassette" as used herein refers to a nucleotide sequence which is capable of affecting expression of a structural gene (i.e., a protein coding sequence, such as a hydrolase of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers. "Operably linked" as used herein refers to linkage of a promoter upstream from a DNA sequence such that the promoter mediates transcription of the DNA sequence. Thus, expression cassettes also include plasmids, expression vectors, recombinant viruses, any form of recombinant "naked DNA" vector, and the like. A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and includes both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

The term "gene" can include a nucleic acid sequence comprising a segment of DNA involved in producing a transcription product (e.g., a message), which in turn is translated to produce a polypeptide chain, or regulates gene transcription, reproduction or stability. Genes can include, inter alia, regions preceding and following the coding region, such as leader and trailer, promoters and enhancers, as well as, where applicable, intervening sequences (introns) between individual coding segments (exons).

The phrases "nucleic acid" or "nucleic acid sequence" can include an oligonucleotide, nucleotide, polynucleotide, or to a fragment of any of these, to DNA or RNA (e.g., mRNA, rRNA, tRNA, RNAi) of genomic or synthetic origin which may be single-stranded or double-stranded and may represent a sense or antisense strand, to peptide nucleic acid (PNA), or to any DNA-like or RNA-like material, natural or synthetic in origin, including, e.g., RNAi (double-stranded "interfering" RNA), ribonucleoproteins (e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors which ensure that genes encoding proteins specific to a given tissue are expressed. Such factors are known to exist in mammals and plants so as to allow for specific tissues to develop.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

"Amino acid" or "amino acid sequence" can include an oligopeptide, peptide, polypeptide, or protein sequence, or to a fragment, portion, or subunit of any of these, and to naturally occurring or synthetic molecules.

The terms "polypeptide" and "protein" can include amino acids joined to each other by peptide bonds or modified peptide bonds, i.e., peptide isosteres, and may contain modified amino acids other than the 20 gene-encoded amino acids. The term "polypeptide" also includes peptides and polypeptide fragments, motifs and the like. The term also includes glycosylated polypeptides. The peptides and polypeptides of the invention also include all "mimetic" and "peptidomimetic" forms, as described in further detail, below.

The term "isolated" can mean that the material is removed from its original environment (e.g., the natural environment if it is naturally occurring). For example, a naturally occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment. As used herein, an isolated material or composition can also be a "purified" composition, i.e., it does not require absolute purity; rather, it is intended as a relative definition. Individual nucleic acids obtained from a library can be conventionally purified to electrophoretic homogeneity. In alternative aspects, the invention provides nucleic acids which have been purified from genomic DNA or from other sequences in a library or other environment by at least one, two, three, four, five or more orders of magnitude.

The term "recombinant" can mean that the nucleic acid is adjacent to a "backbone" nucleic acid to which it is not adjacent in its natural environment. In one aspect, nucleic acids represent 5% or more of the number of nucleic acid inserts in a population of nucleic acid "backbone molecules." "Backbone molecules" according to the invention include nucleic acids such as expression vectors, self-replicating nucleic acids, viruses, integrating nucleic acids, and other vectors or nucleic acids used to maintain or manipulate a nucleic acid insert of interest. In one aspect, the enriched nucleic acids represent 15%, 20%, 30%, 40%, 50%, 60%, 70%, 80%, 90% or more of the number of nucleic acid inserts in the population of recombinant backbone molecules. "Recombinant" polypeptides or proteins refer to polypeptides or proteins produced by recombinant DNA techniques; e.g., produced from cells transformed by an exogenous DNA construct encoding the desired polypeptide or protein. "Synthetic" polypeptides or protein are those prepared by chemical synthesis, as described in further detail, below.

A promoter sequence can be "operably linked to" a coding sequence when RNA polymerase which initiates transcription at the promoter will transcribe the coding sequence into mRNA, as discussed further, below.

"Oligonucleotide" can include either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide will ligate to a fragment that has not been dephosphorylated.

The phrase "substantially identical" in the context of two nucleic acids or polypeptides, can refer to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more, nucleotide or amino acid residue (sequence) identity, when compared and aligned for maximum correspondence, as measured using one any known sequence comparison algorithm, as discussed in detail below, or by visual inspection. In alternative aspects, the invention provides nucleic acid and polypeptide sequences having substantial identity to a nucleic acid of the invention, e.g., an exemplary sequence of the invention, over a region of at least about 10, 20, 30, 40, 50, 100, 150, 200, 250, 300, 350, 400, 450, 500, 550, 600, 650, 700, 750, 800, 850, 900, 950, 1000 residues, or a region ranging from between about 50 residues to the full length of the nucleic acid or polypeptide. Nucleic acid sequences of the invention can be substantially identical over the entire length of a polypeptide coding region.

Additionally a "substantially identical" amino acid sequence is a sequence that differs from a reference sequence by one or more conservative or non-conservative amino acid substitutions, deletions, or insertions, particularly when such a substitution occurs at a site that is not the active site of the molecule, and provided that the polypeptide essentially retains its functional properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a hydrolase, resulting in modification of the structure of the polypeptide, without significantly altering its biological activity. For example, amino-or carboxyl-terminal amino acids that are not required for hydrolase activity can be removed.

"Hybridization" refers to the process by which a nucleic acid strand joins with a complementary strand through base pairing. Hybridization reactions can be sensitive and selective so that a particular sequence of interest can be identified even in samples in which it is present at low concentrations. Stringent conditions can be defined by, for example, the concentrations of salt or formamide in the prehybridization and hybridization solutions, or by the hybridization temperature, and are well known in the art. For example, stringency can be increased by reducing the concentration of salt, increasing the concentration of formamide, or raising the hybridization temperature, altering the time of hybridization, as described in detail, below. In alternative aspects, nucleic acids of the invention are defined by their ability to hybridize under various stringency conditions (e.g., high, medium, and low), as set forth herein.

The term "variant" can include polynucleotides or polypeptides of the invention modified at one or more base pairs, codons, introns, exons, or amino acid residues (respectively) yet still retain the biological activity of a hydrolase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof. Techniques for producing variant hydrolases having activity at a pH or temperature, for example, that is different from a wild-type hydrolase, are included herein.

The term "saturation mutagenesis" or "GSSM" includes a method that uses degenerate oligonucleotide primers to introduce point mutations into a polynucleotide, as described in detail, below. The term "optimized directed evolution system" or "optimized directed evolution" includes a method for reassembling fragments of related nucleic acid sequences, e.g., related genes, and explained in detail, below. The term "synthetic ligation reassembly" or "SLR" includes a method of ligating oligonucleotide fragments in a non-stochastic fashion, and explained in detail, below.

The term "syrup" can be defined as an aqueous solution or slurry comprising carbohydrates such as mono-, oligo-or polysaccharides.

Generating and Manipulating Nucleic Acids

The invention provides nucleic acids, including expression cassettes such as expression vectors, encoding the polypeptides (e.g., hydrolases, antibodies) of the invention. The invention also includes methods for discovering new hydrolase sequences using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like. In practicing the methods of the invention, homologous genes can be modified by manipulating a template nucleic acid, as described herein. The invention can be practiced in conjunction with any method or protocol or device known in the art, which are well described in the scientific and patent literature.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Left. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing amore immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

Transcriptional and Translational Control Sequences

The invention provides nucleic acid (e.g., DNA, iRNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

Promoters suitable for expressing a polypeptide in bacteria include the *E. coli* lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express a hydrolase of the invention in a tissue-specific manner. The invention also provides plants or seeds that express a hydrolase of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression of a hydrolase of the invention, a plant promoter fragment can be employed which will direct expression of a nucleic acid in some or all tissues of a plant, e.g., a regenerated plant. Such "constitutive" promoters and are active under most environmental conditions and states of development or cell differentiation. Examples of constitutive promoters include the cauliflower mosaic virus (CaMV) 35S transcription initiation region, the 1'-or 2'-promoter derived from T-DNA of *Agrobacterium tumefaciens*, and other transcription initiation regions from various plant genes known to those of skill. Such genes include, e.g., ACT11 from *Arabidopsis* (Huang (1996) *Plant Mol. Biol.* 33:125-139); Cat3 from *Arabidopsis* (GenBank No. U43147, Zhong (1996) *Mol. Gen. Genet.* 251:196-203); the gene encoding stearoyl-acyl carrier protein desaturase from *Brassica napus* (Genbank No. X74782, Solocombe (1994) *Plant Physiol.* 104: 1167-1176); GPc1 from maize (GenBank No. X15596; Martinez (1989) *J. Mol. Biol.* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro bacilliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of a hydrolase-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fbl2A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant. Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically-(e.g., hormone-or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

Tissue-specific plant promoters may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the hydrolase-producing nucleic acids of the invention will allow the grower to select plants with the optimal starch/sugar ratio. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

If proper polypeptide expression is desired, a polyadenylation region at the 3'-end of the coding region should be included. The polyadenylation region can be derived from the natural gene, from a variety of other plant genes, or from genes in the Agrobacterial T-DNA.

Expression Vectors and Cloning Vehicles

The invention provides expression vectors and cloning vehicles comprising nucleic acids of the invention, e.g., sequences encoding the hydrolases and antibodies of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skilled in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector may comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP1 gene. Promoter regions can be selected from any desired gene using chloramphenicol transferase (CAT) vectors or other vectors with selectable markers.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

A DNA sequence may be inserted into a vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector may be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which may be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal minichromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234: 243-252), bean golden mosaic virus (see, e.g., Morinaga (1993) Microbiol Immunol. 37:471-476), cauliflower mosaic virus (see, e.g., Cecchini (1997) Mol. Plant. Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

Host Cells and Transformed Cells

The invention also provides a transformed cell comprising a nucleic acid sequence of the invention, e.g., a sequence encoding a hydrolase or an antibody of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Enzymes of the invention can be expressed in any host cell, e.g., any bacterial cell, any yeast cell, e.g., *Pichia pastoris*, *Saccharomyces cerevisiae* or *Schizosaccharomyces pombe*. Exemplary bacterial cells include *E. coli*, *Lactococcus lactis*, *Streptomyces*, *Bacillus subtilis*, *Bacillus cereus*, *Salmonella typhimurium* or any species within the genera *Bacillus*, *Streptomyces* and *Staphylococcus*. Exemplary insect cells include *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477, U.S. Pat. No. 5,750,870.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™, electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are preferred.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Amplification of Nucleic Acids

In practicing the invention, nucleic acids encoding the polypeptides of the invention, or modified nucleic acids, can be reproduced by, e.g., amplification. The invention provides amplification primer sequence pairs for amplifying nucleic acids encoding a hydrolase, e.g., an esterase, acylase, lipase, phospholipase or protease, where the primer pairs are capable of amplifying nucleic acid sequences including the exemplary SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ D NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, SEQ ID NO:511, SEQ ID NO:513, SEQ D NO:515, SEQ ID NO:517, SEQ ID NO:519, SEQ ID NO:521, SEQ ID NO:523, SEQ ID NO:525, SEQ ID NO:527, SEQ ID NO:529, SEQ ID NO:531, SEQ ID NO:533, SEQ ID NO:535, SEQ ID NO:537, SEQ ID NO:539, SEQ ID NO:541, SEQ ID NO:543, SEQ ID NO:545, SEQ ID NO:547, SEQ ID NO:549, SEQ ID NO:551, SEQ ID NO:553, SEQ ID NO:555, SEQ ID NO:557, SEQ ID NO:559, SEQ ID NO:561, SEQ ID NO:563, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:589, SEQ ID NO:591, SEQ ID NO:593, SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619, SEQ ID NO:621, SEQ ID NO:623, SEQ ID NO:625, SEQ ID NO:627, SEQ ID NO:629, SEQ ID NO:631, SEQ ID NO:633, SEQ ID NO:635, SEQ ID NO:637, SEQ ID NO:639, SEQ ID NO:641, SEQ ID NO:643, SEQ ID NO:645, SEQ ID NO:647, SEQ ID NO:649, SEQ ID NO:651, SEQ ID NO:653, SEQ ID NO:655, SEQ ID NO:657, SEQ ID NO:659, SEQ ID NO:661, SEQ ID NO:663, SEQ ID NO:665, SEQ ID NO:667, SEQ ID NO:669, SEQ ID NO:671, SEQ ID NO:673, SEQ ID NO:675, SEQ ID NO:677, SEQ ID NO:679, SEQ ID NO:681, SEQ ID NO:683, SEQ ID NO:685, SEQ ID NO:687, SEQ ID NO:689, SEQ ID NO:691, SEQ ID NO:693, SEQ ID NO:695, SEQ ID NO:697, SEQ ID NO:699, SEQ ID NO:701, SEQ ID NO:703, SEQ ID NO:705, SEQ ID NO:707, SEQ ID NO:709, SEQ ID NO:711, SEQ ID NO:713, SEQ ID NO:715, SEQ ID NO:717, SEQ ID NO:719, SEQ ID NO:721, SEQ ID NO:723, SEQ ID NO:725, SEQ ID NO:727, SEQ ID NO:729, SEQ ID NO:731, SEQ ID NO:733, SEQ ID NO:735, SEQ ID NO:737, SEQ ID NO:739, SEQ ID NO:741, SEQ ID NO:743, SEQ ID NO:745, SEQ ID NO:747, SEQ ID NO:749, SEQ ID NO:751, SEQ ID NO:753, SEQ ID NO:755, SEQ ID NO:757, SEQ ID NO:759, SEQ ID NO:761, SEQ ID NO:763, SEQ ID NO:765, SEQ ID NO:767, SEQ ID NO:769, SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, SEQ ID NO:791, SEQ ID NO:793, SEQ ID NO:795, SEQ ID NO:797, SEQ ID NO:799, SEQ ID NO:801, SEQ ID NO:803, SEQ ID NO:805, SEQ ID NO:807, SEQ ID NO:809, SEQ ID NO:811, SEQ ID NO:813, SEQ ID NO:815, SEQ ID NO:817, SEQ ID NO:819, SEQ ID NO:821, SEQ ID NO:823, SEQ ID NO:825, SEQ ID NO:827, SEQ ID NO:829, SEQ ID NO:831, SEQ ID NO:833, SEQ ID NO:835, SEQ ID NO:837, SEQ ID NO:839, SEQ ID NO:841, SEQ ID NO:843, SEQ ID NO:845, SEQ ID NO:847, SEQ ID NO:849, SEQ ID NO:851, SEQ ID NO:853, SEQ ID NO:855, SEQ ID NO:857, SEQ ID NO:859, SEQ ID NO:861, SEQ ID NO:863, SEQ ID NO:865, SEQ ID NO:867, SEQ ID NO:869, SEQ ID NO:871, SEQ ID NO:873, SEQ ID NO:875, SEQ ID NO:877, SEQ ID NO:879, SEQ ID NO:881, SEQ ID NO:883, SEQ ID NO:885, SEQ ID NO:887, SEQ ID NO:889, SEQ ID NO:891, SEQ ID NO:893, SEQ ID NO:895, SEQ ID NO:897, SEQ ID NO:899, SEQ ID NO:901, SEQ ID NO:903, SEQ ID NO:905, SEQ ID NO:907, SEQ ID NO:909, SEQ ID NO:911, SEQ ID NO:913, SEQ ID NO:915, SEQ ID NO:917, SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, SEQ ID NO:941, SEQ ID NO:943, SEQ ID NO:945, SEQ ID NO:947, SEQ ID NO:949, SEQ ID NO:951 or SEQ ID NO:953. One of skill in the art can design amplification primer sequence pairs for any part of or the full length of these sequences.

Additionally, the invention provides amplification primer sequence pairs for amplifying nucleic acids encoding a hydrolase, e.g., an esterase, acylase, lipase, phospholipase or protease, where the primer pairs are capable of amplifying nucleic acid sequences including the exemplary SEQ ID NO:955, SEQ ID NO:957, SEQ ID NO:959, SEQ ID NO:961, SEQ ID NO:963, SEQ ID NO:965, SEQ ID NO:967, SEQ ID NO:969, SEQ ID NO:971, SEQ ID NO:973, SEQ ID NO:975, SEQ ID NO:977, SEQ ID NO:979, SEQ ID NO:981, or SEQ ID NO:983.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified. The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683, 195 and 4,683,202; Sooknanan (1995) Biotechnology 13:563-564.

The invention also provides amplification primer pairs comprising sequences of the invention, for example, wherein the primer pair comprises a first member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36, 37, 38, 39 or 40 or more residues of a nucleic acid of the invention, and a second member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36, 37, 38, 39 or 40 or more residues of the complementary strand of the first member.

Determining the Degree of Sequence Identity

The invention provides nucleic acids having at least nucleic acid, or complete (100%) sequence identity to a nucleic acid of the invention, e.g., an exemplary nucleic acid of the invention (e.g., having a sequence as set forth in SEQ ID NO:1, SEQ ID NO:3, SEQ ID NO:5, SEQ ID NO:7, SEQ ID NO:9, SEQ ID NO:11, etc.); and polypeptides having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a polypeptide of the invention, e.g., an exemplary polypeptide having a sequence as set forth in SEQ ID NO:2, SEQ ID NO:4, SEQ ID NO:6, SEQ ID NO:8, SEQ ID NO:10, SEQ ID NO:12, etc. In alternative aspects, the sequence identity can be over a region of at least about 5, 10, 20, 30, 40, 50, 100, 150, 200, 250, 300, 350, 400, 450, 500, 550, 600, 650, 700, 750, 800, 850, 900, 950, 1000, or more consecutive residues, or the full length of the nucleic acid or polypeptide. The extent of sequence identity (homology) may be determined using any computer program and associated parameters, including those described herein, such as BLAST 2.2.2. or FASTA version 3.0t78, with the default parameters.

FIG. 30 is a chart describing selected characteristics of exemplary nucleic acids and polypeptides of the invention, including sequence identity comparison of the exemplary sequences to public databases. All sequences described in FIG. 30 have been subject to a BLAST search (as described in detail, below) against two sets of databases. The first database set is available through NCBI (National Center for Biotechnology Information). All results from searches against these databases are found in the columns entitled "NR Description", "NR Accession Code", "NR Evalue" or "NR Organism". "NR" refers to the Non-Redundant nucleotide database maintained by NCBI. This database is a composite of GenBank, GenBank updates, and EMBL updates. The entries in the column "NR Description" refer to the definition line in any given NCBI record, which includes a description of the sequence, such as the source organism, gene name/protein name, or some description of the function of the sequence. The entries in the column "NR Accession Code" refer to the unique identifier given to a sequence record. The entries in the column "NR Evalue" refer to the Expect value (Evalue), which represents the probability that an alignment score as good as the one found between the query sequence (the sequences of the invention) and a database sequence would be found in the same number of comparisons between random sequences as was done in the present BLAST search. The entries in the column "NR Organism" refer to the source organism of the sequence identified as the closest BLAST hit. The second set of databases is collectively known as the Geneseq™ database, which is available through Thomson Derwent (Philadelphia, Pa.). All results from searches against this database are found in the columns entitled "Geneseq Protein Description", "Geneseq Protein Accession Code", "Geneseq Protein Evalue", "Geneseq DNA Description", "Geneseq DNA Accession Code" or "Geneseq DNA Evalue". The information found in these columns is comparable to the information found in the NR columns described above, except that it was derived from BLAST searches against the Geneseq™ database instead of the NCBI databases. In addition, this table includes the column "Predicted EC No.". An EC number is the number assigned to a type of enzyme according to a scheme of standardized enzyme nomenclature developed by the Enzyme Commission of the Nomenclature Committee of the International Union of Biochemistry and Molecular Biology (IUBMB). The results in the "Predicted EC No." column are determined by a BLAST search against the Kegg (Kyoto Encyclopedia of Genes and Genomes) database. If the top BLAST match has an Evalue equal to or less than $e^{-6}$, the EC number assigned to the top match is entered into the table. The EC number of the top hit is used as a guide to what the EC number of the sequence of the invention might be. The columns "Query DNA Length" and "Query Protein Length" refer to the number of nucleotides or the number amino acids, respectively, in the sequence of the invention that was searched or queried against either the NCBI or Geneseq databases. The columns "Geneseq or NR DNA Length" and "Geneseq or NR Protein Length" refer to the number of nucleotides or the number amino acids, respectively, in the sequence of the top match from the BLAST search. The results provided in these columns are from the search that returned the lower Evalue, either from the NCBI databases or the Geneseq database. The columns "Geneseq or NR % ID Protein" and "Geneseq or NR % ID DNA" refer to the percent sequence identity between the sequence of the invention and the sequence of the top BLAST match. The results provided in these columns are from the search that returned the lower Evalue, either from the NCBI databases or the Geneseq database.

Homologous sequences also include RNA sequences in which uridines replace the thymines in the nucleic acid sequences. The homologous sequences may be obtained using any of the procedures described herein or may result from the correction of a sequencing error. It will be appreciated that the nucleic acid sequences as set forth herein can be represented in the traditional single character format (see, e.g., Stryer, Lubert. Biochemistry, 3rd Ed., W. H Freeman & Co., New York) or in any other format which records the identity of the nucleotides in a sequence.

Various sequence comparison programs identified herein are used in this aspect of the invention. Protein and/or nucleic acid sequence identities (homologies) may be evaluated using any of the variety of sequence comparison algorithms and programs known in the art. Such algorithms and programs include, but are not limited to, TBLASTN, BLASTP, FASTA, TFASTA, and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity can be measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection. For sequence comparison, one sequence can act as a reference sequence (e.g., an exemplary nucleic acid or polypeptide sequence of the invention) to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the numbers of contiguous residues. For example, in alternative aspects of the invention, contiguous residues ranging anywhere from 20 to the full length of an exemplary polypeptide or nucleic acid sequence of the invention, are compared to a reference sequence of the same number of contiguous positions after the two sequences are optimally aligned. If the reference sequence has the requisite sequence identity to an exemplary polypeptide or nucleic acid sequence of the invention, e.g., in alternative aspects, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide or nucleic acid sequence of the invention, that sequence is within the scope of the invention. In alternative embodiments, subsequences ranging from about 20 to 600, about 50 to 200, and about 100 to 150 are compared to a reference sequence of the same number of contiguous positions after the two sequences are optimally aligned. Methods of alignment of sequence for comparison are well known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (Gibbs, 1995). Several genomes have been sequenced, e.g., *M. genitalium* (Fraser et al., 1995), *M. jannaschii* (Bult et al., 1996), *H. influenzae* (Fleischmann et al., 1995), *E. coli* (Blattner et al., 1997), and yeast (*S. cerevisiae*) (Mewes et al., 1997), and *D. melanogaster* (Adams et al., 2000). Significant progress has also been made in sequencing the genomes of model organism, such as mouse, *C. elegans*, and *Arabadopsis* sp. Databases containing genomic information annotated with some functional information are maintained by different organization, and are accessible via the internet.

BLAST, BLAST 2.0 and BLAST 2.2.2 algorithms are also used to practice the invention. They are described, e.g., in Altschul (1977) Nuc. Acids Res. 25:3389-3402; Altschul (1990) J. Mol. Biol. 215:403-410. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1990) supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectations (E) of 10, and the BLOSUM62 scoring matrix (see Henikoff & Henikoff (1989) Proc. Natl. Acad. Sci. USA 89:10915) alignments (B) of 50, expectation (E) of 10, M=5, N=−4, and a comparison of both strands. The BLAST algorithm also performs a statistical analysis of the similarity between two sequences (see, e.g., Karlin & Altschul (1993) Proc. Natl. Acad. Sci. USA 90:5873). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01, and most preferably less than about 0.001. In one aspect, protein and nucleic acid sequence homologies are evaluated using the Basic Local Alignment Search Tool ("BLAST"). For example, five specific BLAST programs can be used to perform the following task: (1) BLASTP and BLAST3 compare an amino acid query sequence against a protein sequence database; (2) BLASTN compares a nucleotide query sequence against a nucleotide sequence database; (3) BLASTX compares the six-frame conceptual translation products of a query nucleotide sequence (both strands) against a protein sequence database; (4) TBLASTN compares a query protein sequence against a nucleotide sequence database translated in all six reading frames (both strands); and, (5) TBLASTX compares the six-frame translations of a nucleotide query sequence against the six-frame translations of a nucleotide sequence database. The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation).

In one aspect of the invention, to determine if a nucleic acid has the requisite sequence identity to be within the scope of the invention, the NCBI BLAST 2.2.2 programs is used, default options to blastp. There are about 38 setting options in the BLAST 2.2.2 program. In this exemplary aspect of the invention, all default values are used except for the default filtering setting (i.e., all parameters set to default except filtering which is set to OFF); in its place a "-F F" setting is used, which disables filtering. Use of default filtering often results in Karlin-Altschul violations due to short length of sequence.

The default values used in this exemplary aspect of the invention, and to determine the values in FIG. 30, as discussed above, include:

"Filter for low complexity: ON
Word Size: 3
Matrix: Blosum62
Gap Costs: Existence: 11
Extension: 1"

Other default settings are: filter for low complexity OFF, word size of 3 for protein, BLOSUM62 matrix, gap existence penalty of −11 and a gap extension penalty of −1. An exemplary NCBI BLAST 2.2.2 program setting is set forth in Example 1, below. Note that the "-W" option defaults to 0. This means that, if not set, the word size defaults to 3 for proteins and 11 for nucleotides.

Computer Systems and Computer Program Products

To determine and identify sequence identities, structural homologies, motifs and the like in silico, the sequence of the invention can be stored, recorded, and manipulated on any medium which can be read and accessed by a computer. Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

Another aspect of the invention is a computer readable medium having recorded thereon at least one nucleic acid and/or polypeptide sequence of the invention. Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Figure 1:
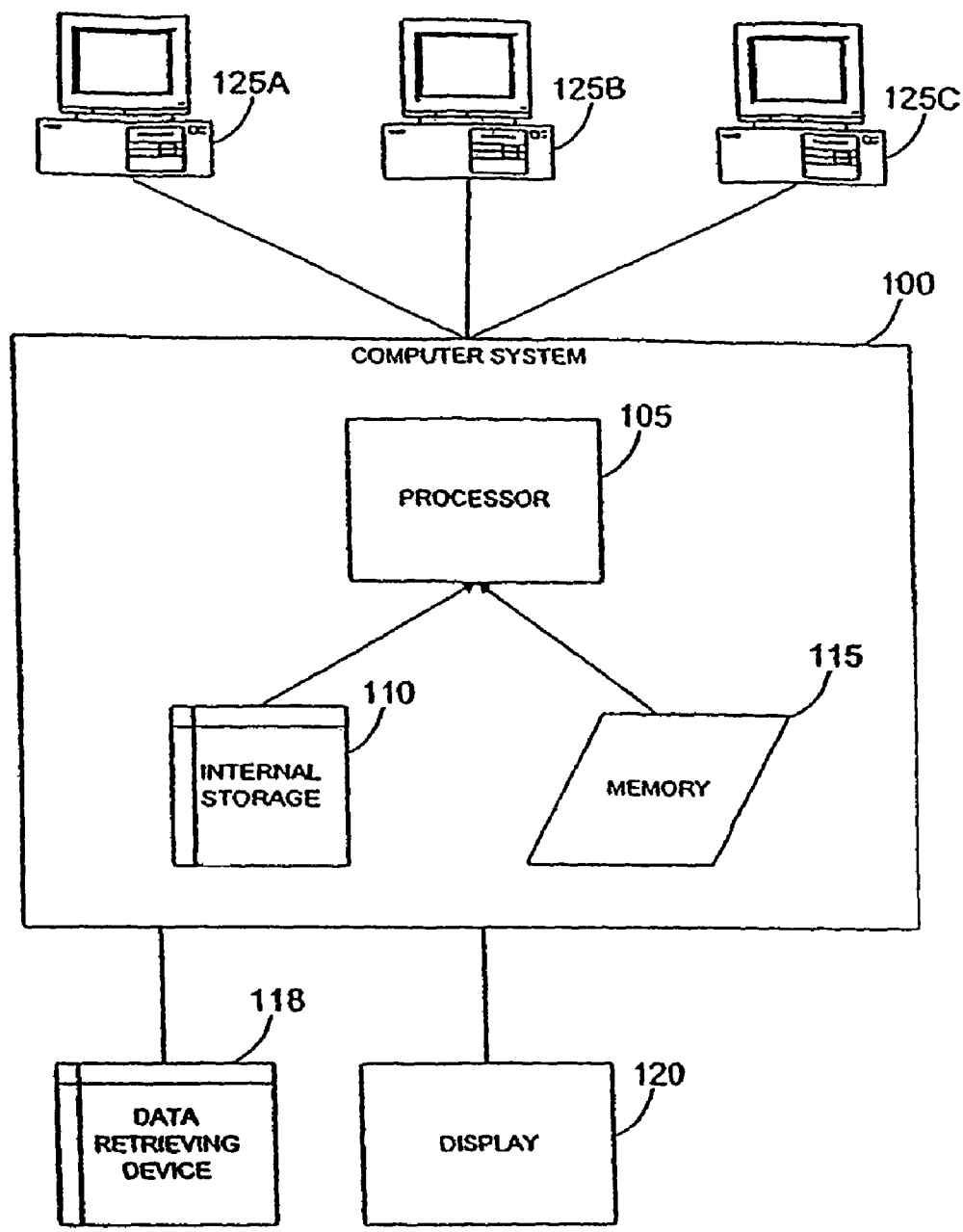
FIG. 1 is a block diagram of a computer system.

Aspects of the invention include systems (e.g., internet based systems), particularly computer systems, which store and manipulate the sequences and sequence information described herein. One example of a computer system 100 is illustrated in block diagram form in FIG. 1. As used herein, "a computer system" refers to the hardware components, software components, and data storage components used to analyze a nucleotide or polypeptide sequence of the invention. The computer system 100 can include a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines. The computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one aspect, the computer system 100 includes a processor 105 connected to a bus which is connected to a main memory 115 (preferably implemented as RAM) and one or more internal data storage devices 110, such as a hard drive and/or other computer readable media having data recorded thereon. The computer system 100 can further include one or more data retrieving device 118 for reading the data stored on the internal data storage devices 110. The data retrieving device 118 may represent, for example, a floppy disk drive, a compact disk drive, a magnetic tape drive, or a modem capable of connection to a remote data storage system (e.g., via the internet) etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device. The computer system 100 includes a display 120 which is used to display output to a computer user. It should also be noted that the computer system 100 can be linked to other computer systems 125a-c in a network or wide area network to provide centralized access to the computer system 100. Software for accessing and processing the nucleotide or amino acid sequences of the invention can reside in main memory 115 during execution. In some aspects, the computer system 100 may further comprise a sequence comparison algorithm for comparing a nucleic acid sequence of the invention. The algorithm and sequence(s) can be stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of the invention stored on a computer readable medium to reference sequences stored on a computer readable medium to identify homologies or structural motifs.

Figure 2:
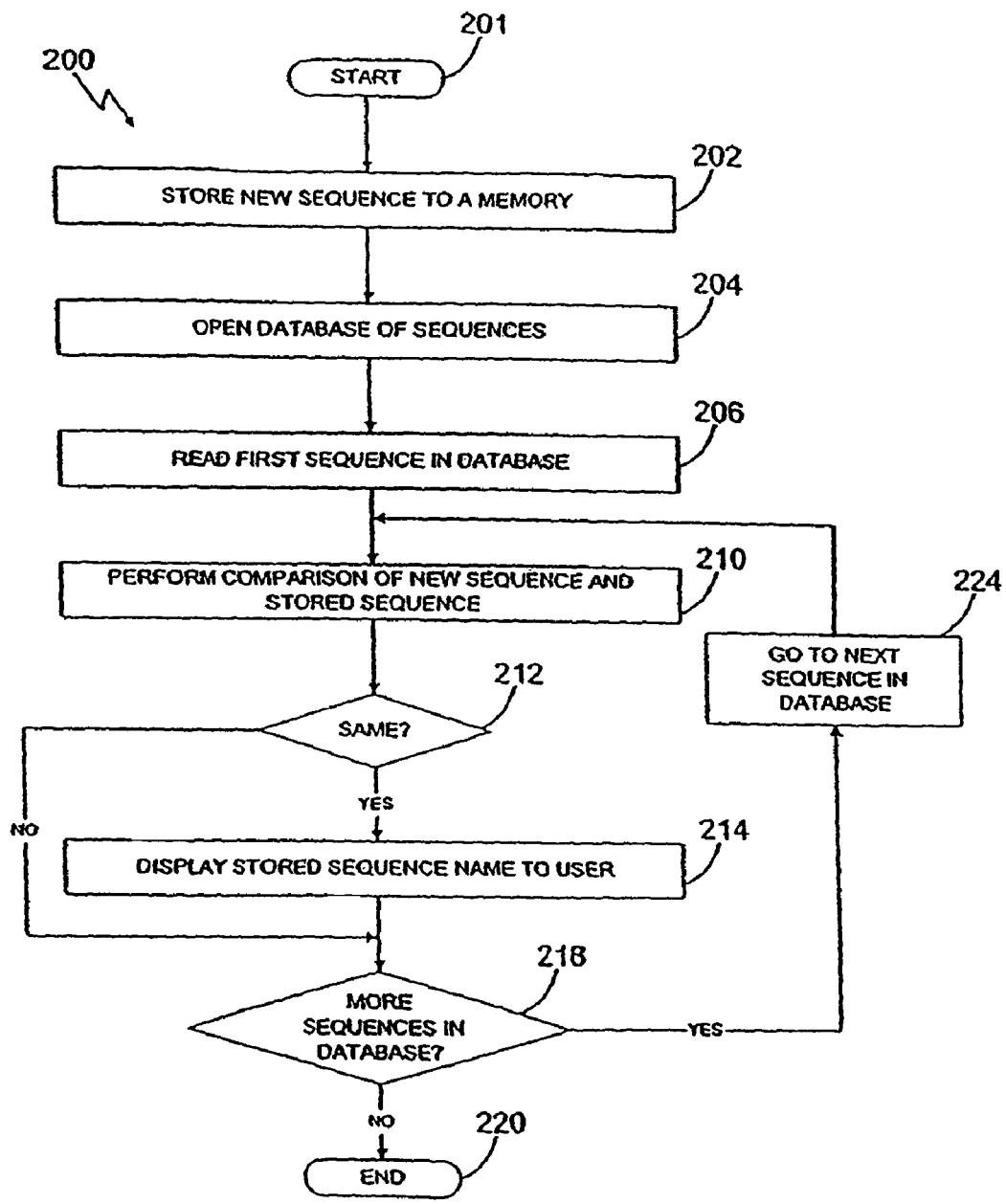
FIG. 2 is a flow diagram illustrating one aspect of a process for comparing a new nucleotide or protein sequence with a database of sequences in order to determine the homology levels between the new sequence and the sequences in the database.
Figure 3:
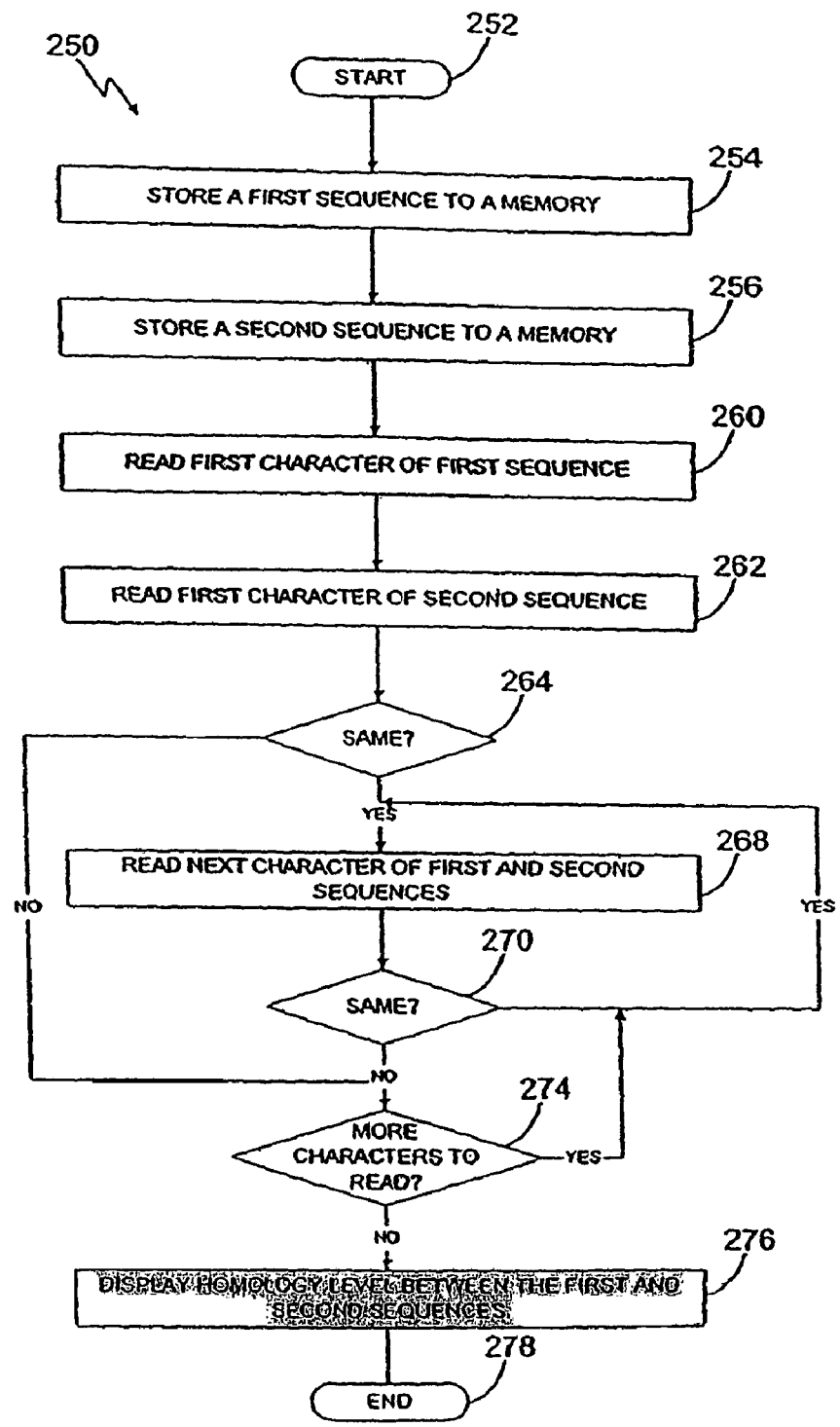
FIG. 3 is a flow diagram illustrating one aspect of a process in a computer for determining whether two sequences are homologous.

The parameters used with the above algorithms may be adapted depending on the sequence length and degree of homology studied. In some aspects, the parameters may be the default parameters used by the algorithms in the absence of instructions from the user. FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet. The process 200 begins at a start state 201 and then moves to a state 200 wherein the new sequence to be compared is stored to a memory in a computer system 100. As discussed above, the memory could be any type of memory, including RAM or an internal storage device. The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system. Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200. If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database. It should be noted that if a determination had been made at the decision state 212 that the sequences were not homologous, then the process 200 would move immediately to the decision state 218 in order to determine if any other sequences were available in the database for comparison. Accordingly, one aspect of the invention is a computer system comprising a processor, a data storage device having stored thereon a nucleic acid sequence of the invention and a sequence comparer for conducting the comparison. The sequence comparer may indicate a homology level between the sequences compared or identify structural motifs, or it may identify structural motifs in sequences which are compared to these nucleic acid codes and polypeptide codes. FIG. 3 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it can be a single letter amino acid code so that the first and sequence sequences can be easily compared. A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read. If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with an every character in a second sequence, the homology level would be 100%.

Alternatively, the computer program can compare a reference sequence to a sequence of the invention to determine whether the sequences differ at one or more positions. The program can record the length and identity of inserted, deleted or substituted nucleotides or amino acid residues with respect to the sequence of either the reference or the invention. The computer program may be a program which determines whether a reference sequence contains a single nucleotide polymorphism (SNP) with respect to a sequence of the invention, or, whether a sequence of the invention comprises a SNP of a known sequence. Thus, in some aspects, the computer program is a program which identifies SNPs. The method may be implemented by the computer systems described above and the method illustrated in FIG. 3. The method can be performed by reading a sequence of the invention and the reference sequences through the use of the computer program and identifying differences with the computer program.

Figure 4:
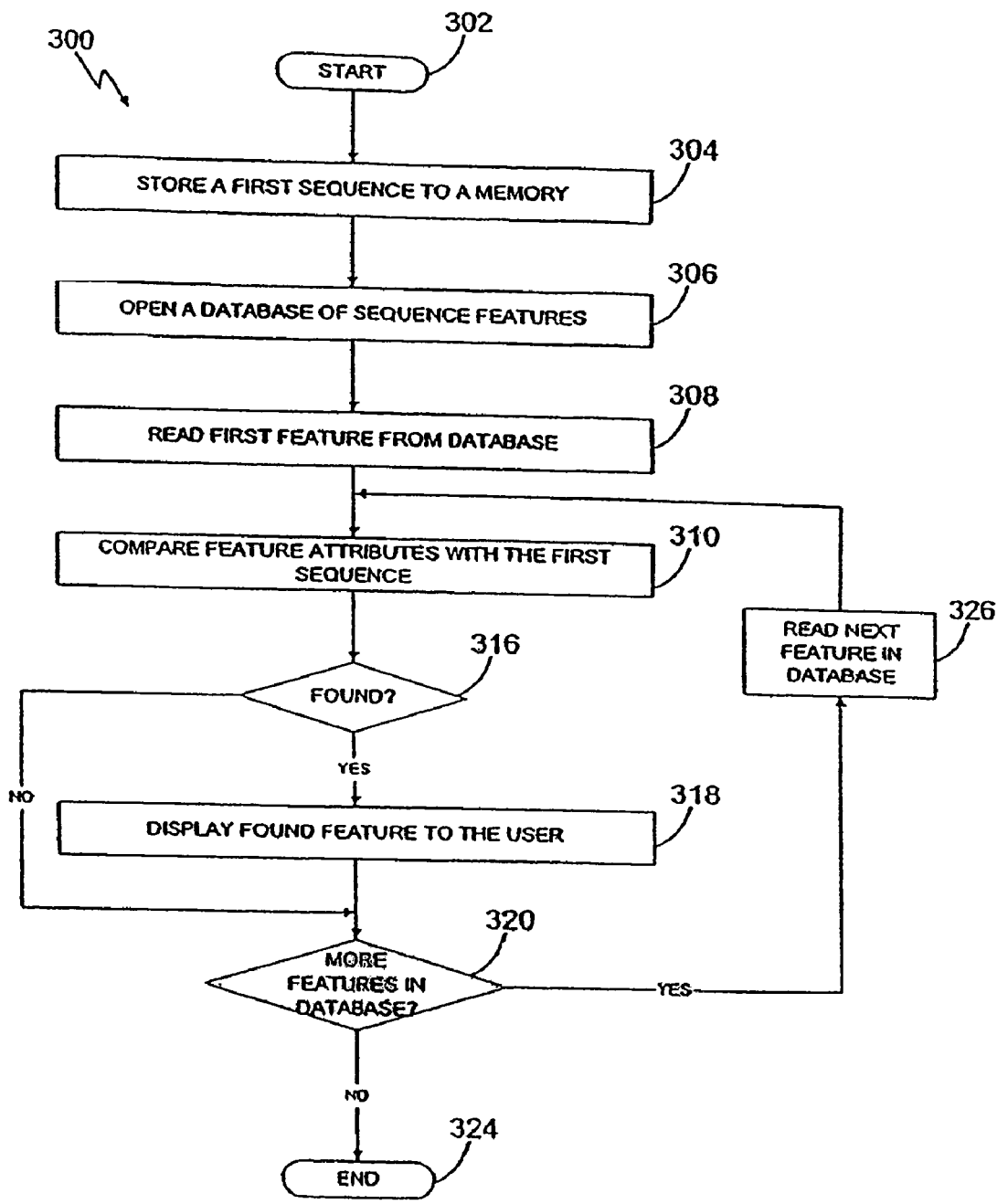
FIG. 4 is a flow diagram illustrating one aspect of an identifier process 300 for detecting the presence of a feature in a sequence.
Figure 5:
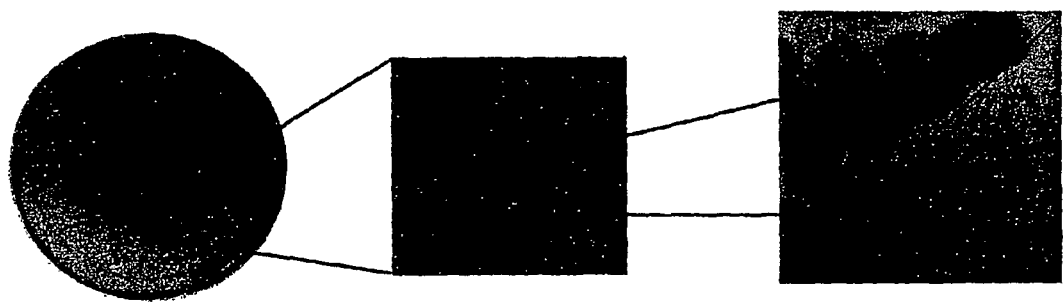
FIG. 5 illustrates an exemplary method of the invention to test for lipase activity, a colorimetric lipase assay, as described in Example 1, below.

In other aspects the computer based system comprises an identifier for identifying features within a nucleic acid or polypeptide of the invention. An "identifier" refers to one or more programs which identifies certain features within a nucleic acid sequence. For example, an identifier may comprise a program which identifies an open reading frame (ORF) in a nucleic acid sequence. FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art. Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user. The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. If the feature attribute is not found in the first sequence at the decision state 316, the process 300 moves directly to the decision state 320 in order to determine if any more features exist in the database. Thus, in one aspect, the invention provides a computer program that identifies open reading frames (ORFs).

A polypeptide or nucleic acid sequence of the invention may be stored and manipulated in a variety of data processor programs in a variety of formats. For example, a sequence can be stored as text in a word processing file, such as Microsoft WORD or WORDPERFECT or as an ASCII file in a variety of database programs familiar to those of skill in the art, such as DB2, SYBASE, or ORACLE. In addition, many computer programs and databases may be used as sequence comparison algorithms, identifiers, or sources of reference nucleotide sequences or polypeptide sequences to be compared to a nucleic acid sequence of the invention. The programs and databases used to practice the invention include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius2.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwent's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Hybridization of Nucleic Acids

The invention provides isolated or recombinant nucleic acids that hybridize under stringent conditions to nucleic acid of the invention, e.g., an exemplary sequence of the invention, e.g., a sequence as set forth in SEQ ID NO:1, SEQ ID NO:3, SEQ ID NO:5, SEQ ID NO:7, SEQ ID NO:9, SEQ ID NO:11, etc., and subsequences thereof, or a nucleic acid that encodes a polypeptide of the invention. The stringent conditions can be highly stringent conditions, medium stringent conditions, low stringent conditions, including the high and reduced stringency conditions described herein.

In alternative embodiments, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA, antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 n/ml sheared and denatured salmon sperm DNA). In one aspect, nucleic acids of the invention are defined by their ability to hybridize under reduced stringency conditions comprising 35% formamide at a reduced temperature of 35° C.

Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

The temperature range corresponding to a particular level of stringency can be further narrowed by calculating the purine to pyrimidine ratio of the nucleic acid of interest and adjusting the temperature accordingly. Nucleic acids of the invention are also defined by their ability to hybridize under high, medium, and low stringency conditions as set forth in Ausubel and Sambrook. Variations on the above ranges and conditions are well known in the art. Hybridization conditions are discussed further, below.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a $Na^+$ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68°C. for 15 minutes; or, equivalent conditions. See Sambrook Tijssen and Ausubel for a description of SSC buffer and equivalent conditions.

These methods may be used to isolate nucleic acids of the invention.

Oligonucleotides Probes and Methods for Using Them

The invention also provides nucleic acid probes for identifying nucleic acids encoding a polypeptide with a hydrolase activity, e.g., an esterase, acylase, lipase, phospholipase or protease activity. In one aspect, the probe comprises at least 10 consecutive bases of a nucleic acid of the invention. Alternatively, a probe of the invention can be at least about 5, 6, 7, 8, 9, 10, 15, 20, 25, 30, 35, 40, 45, 50, 60, 70, 80, 90, 100, 110, 120, 130, 150, 160, 170, 180, 190, 200 or more, or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The probes of the invention can be used to determine whether a biological sample, such as a soil sample, contains an organism having a nucleic acid sequence of the invention (e.g., a hydrolase-encoding nucleic acid) or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences present in the sample. Where necessary, conditions which permit the probe to specifically hybridize to complementary sequences may be determined by placing the probe in contact with complementary sequences from samples known to contain the complementary sequence, as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids (see discussion on specific hybridization conditions).

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product. Many methods for using the labeled probes to detect the presence of complementary nucleic acids in a sample are familiar to those skilled in the art. These include Southern Blots, Northern Blots, colony hybridization procedures, and dot blots. Protocols for each of these procedures are provided in Ausubel and Sambrook.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). In one aspect, the probes comprise oligonucleotides. In one aspect, the amplification reaction may comprise a PCR reaction. PCR protocols are described in Ausubel and Sambrook (see discussion on amplification reactions). In such procedures, the nucleic acids in the sample are contacted with the probes, the amplification reaction is performed, and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the 3' or 5' ends of a nucleic acid sequence of the invention can also be used in chromosome walking procedures to identify clones containing additional, e.g., genomic sequences. Such methods allow the isolation of genes which encode additional proteins of interest from the host organism.

In one aspect, nucleic acid sequences of the invention are used as probes to identify and isolate related nucleic acids. In some aspects, the so-identified related nucleic acids may be cDNAs or genomic DNAs from organisms other than the one from which the nucleic acid of the invention was first isolated. In such procedures, a nucleic acid sample is contacted with the probe under conditions which permit the probe to specifically hybridize to related sequences. Hybridization of the probe to nucleic acids from the related organism is then detected using any of the methods described above.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content), and nucleic acid type (e.g., RNA v. DNA) of the hybridizing regions of the nucleic acids can be considered in selecting hybridization conditions. An additional consideration is whether one of the nucleic acids is immobilized, for example, on a filter. Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM NaH$_2$PO4, pH 7.0, 5.0 mM Na$_2$EDTA, 0.5% SDS, 10× Denhardt's, and 0.5 mg/ml polyriboadenylic acid. Approximately 2×107 cpm (specific activity 4-9×108 cpm/ug) of 32P end-labeled oligonucleotide probe are then added to the solution. After 12-16 hours of incubation, the membrane is washed for 30 minutes at room temperature (RT) in 1×SET (150 mM NaCl, 20 mM Tris hydrochloride, pH 7.8, 1 mM Na2EDTA) containing 0.5% SDS, followed by a 30 minute wash in fresh 1×SET at Tm-10° C. for the oligonucleotide probe. The membrane is then exposed to auto-radiographic film for detection of hybridization signals.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, Tm, is the temperature (under defined ionic strength and pH) at which 50% of the target sequence hybridizes to a perfectly complementary probe. Very stringent conditions are selected to be equal to or about 5° C. lower than the Tm for a particular probe. The melting temperature of the probe may be calculated using the following exemplary formulas. For probes between 14 and 70 nucleotides in length the melting temperature (Tm) is calculated using the formula: Tm=81.5+16.6(log [Na+])+0.41 (fraction G+C)−(600/N) where N is the length of the probe. If the hybridization is carried out in a solution containing formamide, the melting temperature may be calculated using the equation: Tm=81.5+16.6(log [Na+])+0.41 (fraction G+C)−(0.63% formamide)−(600/N) where N is the length of the probe. Prehybridization may be carried out in 6×SSC, 5× Denhardt's reagent, 0.5% SDS, 100 µg denatured fragmented salmon sperm DNA or 6×SSC, 5× Denhardt's reagent, 0.5% SDS, 100 µg denatured fragmented salmon sperm DNA, 50% formamide. Formulas for SSC and Denhardt's and other solutions are listed, e.g., in Sambrook.

In one aspect, hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the Tm. For shorter probes, such as oligonucleotide probes, the hybridization may be conducted at 5-10° C. below the Tm. In one aspect, hybridizations in 6×SSC are conducted at approximately 68° C. In one aspect, hybridizations in 50% formamide containing solutions are conducted at approximately 42° C. All of the foregoing hybridizations would be considered to be under conditions of high stringency.

In one aspect, following hybridization, the filter is washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content), and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes.

Nucleic acids which have hybridized to the probe can be identified by autoradiography or other conventional techniques. The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. An example of "moderate" hybridization conditions is when the above hybridization is conducted at 55° C. An example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

These probes and methods of the invention can be used to isolate, or identify (e.g., using an array), nucleic acids having a sequence with at least about 950%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, sequence identity to a nucleic acid sequence of the invention comprising at least about 10, 15, 20, 25, 30, 35, 40, 50, 75, 100, 150, 200, 250, 300, 350, 400, 500, 550, 600, 650, 700, 750, 800, 850, 900, 950, 1000, or more consecutive bases thereof, and the sequences complementary thereto. Homology may be measured using an alignment algorithm, as discussed herein. For example, the homologous polynucleotides may have a coding sequence which is a naturally occurring allelic variant of one of the coding sequences described herein. Such allelic variants may have a substitution, deletion or addition of one or more nucleotides when compared to a nucleic acid of the invention.

Additionally, the probes and methods of the invention may be used to isolate, or identify (e.g., using an array), nucleic acids which encode polypeptides having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to a polypeptide of the invention comprising at least 5, 10, 15, 20, 25, 30, 35, 40, 50, 75, 100, or 150 or more consecutive amino acids thereof as determined using a sequence alignment algorithm, e.g., such as the FASTA version 3.0t78 algorithm with the default parameters, or a BLAST 2.2.2 program with exemplary settings as set forth herein.

Inhibiting Expression of Hydrolases

The invention further provides for nucleic acids complementary to (e.g., antisense sequences to) the nucleic acid sequences of the invention, e.g., hydrolase-encoding sequences. Antisense sequences are capable of inhibiting the transport, splicing or transcription of hydrolase-encoding genes. The inhibition can be effected through the targeting of genomic DNA or messenger RNA. The inhibition can be effected using DNA, e.g., an inhibitory ribozyme, or an RNA, e.g., a double-stranded iRNA, comprising a sequence of the invention. The transcription or function of targeted nucleic acid can be inhibited, for example, by hybridization and/or cleavage. The invention provides a set of inhibitors comprising oligonucleotides capable of binding hydrolase gene and/ or message, in either case preventing or inhibiting the production or function of hydrolase. The association can be through sequence specific hybridization. Another useful class of inhibitors includes oligonucleotides which cause inactivation or cleavage of hydrolase message. The oligonucleotide can have enzyme activity which causes such cleavage, such as ribozymes. The oligonucleotide can be chemically modified or conjugated to an enzyme or composition capable of cleaving the complementary nucleic acid. One may screen a pool of many different such oligonucleotides for those with the desired activity.

Antisense Oligonucleotides

The invention provides antisense oligonucleotides capable of binding hydrolase message which can inhibit hydrolase activity by targeting mRNA or genomic DNA. Strategies for designing antisense oligonucleotides are well described in the scientific and patent literature, and the skilled artisan can design such hydrolase oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

In one aspect, recombinantly generated, or, isolated naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The antisense oligonucleotides can be single stranded or double-stranded RNA or DNA. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphoro-dithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense hydrolase sequences of the invention (see, e.g., Gold (1995) J. of Biol. Chem. 270:13581-13584).

Inhibitory Ribozymes

The invention provides for with ribozymes capable of binding hydrolase message that can inhibit hydrolase activity by targeting mRNA. Strategies for designing ribozymes and selecting the hydrolase-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary basepairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it is typically released from that RNA and so can bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The enzymatic ribozyme RNA molecule can be formed in a hammerhead motif, but may also be formed in the motif of a hairpin, hepatitis delta virus, group I intron or RnaseP-like RNA (in association with an RNA guide sequence). Examples of such hammerhead motifs are described by Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting; those skilled in the art will recognize that an enzymatic RNA molecule of this invention has a specific substrate binding site complementary to one or more of the target gene RNA regions, and has nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a hydrolase sequence of the invention. The RNAi molecule comprises a double-stranded RNA (dsRNA) molecule. The RNAi can inhibit expression of a hydrolase gene. In one aspect, the RNAi is about 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's of the invention. The process may be practiced in vitro, ex vivo or in vivo. In one aspect, the RNAi molecules of the invention can be used to generate a loss-of-function mutation in a cell, an organ or an animal. Methods for making and using RNAi molecules for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding a hydrolase or an antibody of the invention. These methods can be repeated or used in various combinations to generate hydrolases or antibodies having an altered or different activity or an altered or different stability from that of a hydrolase or antibody encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photoactivated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller & Smith (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100: 468-500; and Zoller & Smith (1987) Oligonucleotide-directed mutagenesis: a simple method using two oligonucleotide primers and a single-stranded DNA template" Methods in Enzymol. 154:329-350); phosphorothioate-modified DNA mutagenesis (Taylor et al. (1985) "The use of phosphorothioate-modified DNA in restriction enzyme reactions to prepare nicked DNA" Nucl. Acids Res. 13: 8749-8764; Taylor et al. (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers et al. (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer et al. (1988) "Improved enzymatic in vitro reactions in the gapped duplex DNA approach to oligonucleotide-directed construction of mutations" Nucl. Acids Res. 16: 7207; and Fritz et al. (1988) "Oligonucleotide-directed construction of mutations: a gapped duplex DNA procedure without enzymatic reactions in vitro" Nucl. Acids Res. 16: 6987-6999).

Additional protocols used in the methods of the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Additional protocols used in the methods of the invention include those discussed in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. Patent application serial no. (U.S. Ser. No.) 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423,542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/011138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis (GSSM), synthetic ligation reassembly (SLR), or a combination thereof are used to modify the nucleic acids of the invention to generate hydrolases with new or altered properties (e.g., activity under highly acidic or alkaline conditions, high temperatures, and the like). Polypeptides encoded by the modified nucleic acids can be screened for an activity before testing for proteolytic or other activity. Any testing modality or protocol can be used, e.g., using a capillary array platform. See, e.g., U.S. Pat. Nos. 6,361,974; 6,280,926; 5,939,250.

Saturation Mutagenesis, or, GSSM

In one aspect of the invention, non-stochastic gene modification, a "directed evolution process," is used to generate hydrolases and antibodies with new or altered properties. Variations of this method have been termed "gene site-saturation mutagenesis," "site-saturation mutagenesis," "saturation mutagenesis" or simply "GSSM." It can be used in combination with other mutagenization processes. See, e.g., U.S. Pat. Nos. 6,171,820; 6,238,884. In one aspect, GSSM comprises providing a template polynucleotide and a plurality of oligonucleotides, wherein each oligonucleotide comprises a sequence homologous to the template polynucleotide, thereby targeting a specific sequence of the template polynucleotide, and a sequence that is a variant of the homologous gene; generating progeny polynucleotides comprising non-stochastic sequence variations by replicating the template polynucleotide with the oligonucleotides, thereby generating polynucleotides comprising homologous gene sequence variations.

In one aspect, codon primers containing a degenerate N,N,G/T sequence are used to introduce point mutations into a polynucleotide, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position×100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., hydrolases, e.g., esterases, acylases, lipases, phospholipases or proteases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., *E. coli* host, using, e.g., an expression vector) and subjected to expression screening. When an individual progeny polypeptide is identified by screening to display a favorable change in property. (when compared to the parental polypeptide, such as increased proteolytic activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In another aspect, site-saturation mutagenesis can be used together with another stochastic or non-stochastic means to vary sequence, e.g., synthetic ligation reassembly (see below), shuffling, chimerization, recombination and other mutagenizing processes and mutagenizing agents. This invention provides for the use of any mutagenizing process (es), including saturation mutagenesis, in an iterative manner.

Synthetic Ligation Reassembly (SLR)

The invention provides a non-stochastic gene modification system termed "synthetic ligation reassembly," or simply "SLR," a "directed evolution process," to generate hydrolases and antibodies with new or altered properties. SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. patent application Ser. No. (U.S. Ser. No.)09/332,835 entitled "Synthetic Ligation Reassembly in Directed Evolution" and filed on Jun. 14, 1999 ("U.S. Ser. No. 09/332,835"). In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over 10100 different chimeras. SLR can be used to generate libraries comprised of over 101000 different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

In another aspect, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g. by mutagenesis) or in an in vivo process (e.g. by utilizing the gene splicing ability of a host organism). It is appreciated that in many instances the introduction of these nucleotides may also be desirable for many other reasons in addition to the potential benefit of creating a serviceable demarcation point.

In one aspect, a nucleic acid building block is used to introduce an intron. Thus, functional introns are introduced into a man-made gene manufactured according to the methods described herein. The artificially introduced intron(s) can be functional in a host cells for gene splicing much in the way that naturally-occurring introns serve functionally in gene splicing.

Optimized Directed Evolution System

The invention provides a non-stochastic gene modification system termed "optimized directed evolution system" to generate hydrolases and antibodies with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLAB™ (The Mathworks, Natick, Mass.) a programming language and development environment for technical computing.

Iterative Processes

In practicing the invention, these processes can be iteratively repeated. For example a nucleic acid (or, the nucleic acid) responsible for an altered hydrolase or antibody phenotype is identified, re-isolated, again modified, re-tested for activity. This process can be iteratively repeated until a desired phenotype is engineered. For example, an entire biochemical anabolic or catabolic pathway can be engineered into a cell, including proteolytic activity.

Similarly, if it is determined that a particular oligonucleotide has no affect at all on the desired trait (e.g., a new hydrolase phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, hydrolases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In one aspect, the invention provides a method for producing a hybrid polynucleotide from at least a first polynucleotide and a second polynucleotide. The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

Producing Sequence Variants

The invention also provides methods of making sequence variants of the nucleic acid and hydrolase and antibody sequences of the invention or isolating hydrolases using the nucleic acids and polypeptides of the invention. In one aspect, the invention provides for variants of a hydrolase gene of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, MgCl$_2$, MnCl$_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM MgCl$_2$, 0.5 mM MnCl$_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids is evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/:1 in a solution of 0.2 mM of each dNTP, 2.2 mM MgCl$_2$, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described, e.g., in PCT Publication No. WO 91/16427.

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described, e.g., in Arkin (1992) Proc. Natl. Acad. Sci. USA 89:7811-7815.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described, e.g., in Delegrave (1993) Biotechnology Res. 11:1548-1552. Random and site-directed mutagenesis are described, e.g., in Arnold (1993) Current Opinion in Biotechnology 4:450-455.

In some aspects, the variants are created using shuffling procedures wherein portions of a plurality of nucleic acids which encode distinct polypeptides are fused together to create chimeric nucleic acid sequences which encode chimeric polypeptides as described in, e.g., U.S. Pat. Nos. 5,965,408; 5,939,250.

The invention also provides variants of polypeptides of the invention comprising sequences in which one or more of the amino acid residues (e.g., of an exemplary polypeptide, such as SEQ ID NO:2, SEQ ID NO:4, SEQ ID NO:6, SEQ ID NO:8, etc.) are substituted with a conserved or non-conserved amino acid residue (e.g., a conserved amino acid residue) and such substituted amino acid residue may or may not be one encoded by the genetic code. Conservative substitutions are those that substitute a given amino acid in a polypeptide by another amino acid of like characteristics. Thus, polypeptides of the invention include those with conservative substitutions of sequences of the invention, e.g., the exemplary sequences of the invention, such as SEQ ID NO:2, SEQ ID NO:4, SEQ ID NO:6, SEQ ID NO:8, etc., including but not limited to the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue. Other variants are those in which one or more of the amino acid residues of the polypeptides of the invention includes a substituent group.

Other variants within the scope of the invention are those in which the polypeptide is associated with another compound, such as a compound to increase the half-life of the polypeptide, for example, polyethylene glycol. Additional variants within the scope of the invention are those in which additional amino acids are fused to the polypeptide, such as a leader sequence, a secretory sequence, a proprotein sequence or a sequence which facilitates purification, enrichment, or stabilization of the polypeptide. In some aspects, the variants, fragments, derivatives and analogs of the polypeptides of the invention retain the same biological function or activity as the exemplary polypeptides, e.g., a proteolytic activity, as described herein. In other aspects, the variant, fragment, derivative, or analog includes a proprotein, such that the variant, fragment, derivative, or analog can be activated by cleavage of the proprotein portion to produce an active polypeptide.

Optimizing Codons to Achieve High Levels of Protein Expression in Host Cells

The invention provides methods for modifying hydrolase-encoding nucleic acids to modify codon usage. In one aspect, the invention provides methods for modifying codons in a nucleic acid encoding a hydrolase to increase or decrease its expression in a host cell, e.g., a bacterial, insect, mammalian, yeast or plant cell. The invention also provides nucleic acids encoding a hydrolase modified to increase its expression in a host cell, hydrolase so modified, and methods of making the modified hydrolases. The method comprises identifying a "non-preferred" or a "less preferred" codon in hydrolase-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli*; gram positive bacteria, such as any *Bacillus* (e.g., *B. cereus* or *B. subtilis*) or *Streptomyces, Lactobacillus gasseri, Lactococcus lactis, Lactococcus cremoris*. Exemplary host cells also include eukaryotic organisms, e.g., various yeast, such as *Saccharomyces* sp., including *Saccharomyces cerevisiae, Schizosaccharomyces pombe, Pichia pastoris*, and *Kluyveromyces lactis, Hansenula polymorpha, Aspergillus niger*, and mammalian cells and cell lines and insect cells and cell lines.

Thus, the invention also includes nucleic acids and polypeptides optimized for expression in these organisms and species.

For example, the codons of a nucleic acid encoding a hydrolase isolated from a bacterial cell are modified such that the nucleic acid is optimally expressed in a bacterial cell different from the bacteria from which the hydrolase was derived, a yeast, a fingi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Inmun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., a hydrolase or an antibody of the invention), an expression cassette, a vector, a transfected or a transformed cell of the invention. The transgenic non-human animals can be, e.g., goats, rabbits, sheep, pigs, cows, rats and mice, comprising the nucleic acids of the invention. These animals can be used, e.g., as in vivo models to study hydrolase activity, or, as models to screen for agents that change the hydrolase activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a hydrolase of the invention, or, a fusion protein comprising a hydrolase of the invention. As noted above, functional knockouts can also be generated using antisense sequences of the invention, e.g., double-stranded RNAi molecules.

Transgenic Plants and Seeds

The invention provides transgenic plants and seeds comprising a nucleic acid, a polypeptide (e.g., a hydrolase or an antibody of the invention), an expression cassette or vector or a transfected or transformed cell of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's hydrolase production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on oilseed producing plants, including rice bran, rapeseed (canola), sunflower, olive, palm or soy, and the like, or on glucose or starch-producing plants, such as corn, potato, wheat, rice, barley, and the like. Nucleic acids of the invention can be used to manipulate metabolic pathways of a plant in order to optimize or alter host's expression of a hydrolase or a substrate or product of a hydrolase, e.g., an oil, a lipid, such as a mono-, di-or tri-acylglyceride and the like. The can change the ratios of lipids, lipid conversion and turnover in a plant. This can facilitate industrial processing of a plant. Alternatively, hydrolases of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, optionally, marker genes into a target expression construct (e.g., a plasmid, a phage), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327:70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496-498; Fraley (1983) *Proc. Natl. Acad. Sci. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant with altered, increased and/or decreased lipid or oil content) can be enhanced when both parental plants express the polypeptides of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and *Zea*.

In alternative embodiments, the nucleic acids of the invention are expressed in plants which contain fiber cells, including, e.g., cotton, silk cotton tree (Kapok, *Ceiba pentandra*), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense*, and *G. hirsutum*.

The invention also provides for transgenic plants to be used for producing large amounts of the polypeptides (e.g., antibodies, hydrolases) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

In one aspect, the invention produces fatty acids or fatty acid derivatives from transgenic plants of the invention, e.g., transgenic oleaginous plants. In one aspect, transgenic oleaginous plants comprising at least one hydrolase of the invention are produced. In one aspect, the transgenic plant comprises a hydrolase gene operably linked to a promoter, permitting an expression of the gene either in cellular, extracellular or tissue compartments other than those in which the plant lipids accumulate, or permitting exogenous induction of the hydrolase. In one aspect, seeds and/or fruits containing the lipids of the plants are collected, the seeds and/or fruits are crushed (if necessary after hydrolase (e.g., lipase) gene-induction treatment) so as to bring into contact the lipids and hydrolase of the invention contained in the seeds and/or fruits. The mixture can be allowed to incubate to allow enzymatic hydrolysis of the lipids of the ground material by catalytic action of the lipase of the invention contained in the crushed material. In one aspect, the fatty acids formed by the hydrolysis are extracted and/or are converted in order to obtain the desired fatty acid derivatives.

This enzymatic hydrolysis process of the invention uses mild operating conditions and can be small-scale and use inexpensive installations. In this aspect the plant of the invention is induced to produce the hydrolase for transformation of plant lipids. Using this strategy, the enzyme is prevented from coming into contact with stored plant lipids so as to avoid any risk of premature hydrolysis ("self-degradation of the plant") before harvesting. The crushing and incubating units can be light and small-scale; many are known in the agricultural industry and can be carried out at the sites where the plants are harvested.

In one aspect, transgenic plants of the invention are produced by transformation of natural oleaginous plants. The genetically transformed plants of the invention are then reproduced sexually so as to produce transgenic seeds of the invention. These seeds can be used to obtain transgenic plant progeny.

In one aspect, the hydrolase gene is operably linked to an inducible promoter to prevent any premature contact of hydrolase and plant lipid. This promoter can direct the expression of the gene in compartments other than those where the lipids accumulate or the promoter can initiate the expression of the hydrolase at a desired time by an exogenous induction.

Polypeptides and Peptides

The invention provides isolated or recombinant polypeptides having a sequence identity (e.g., at least 50% sequence identity) to an exemplary sequence of the invention, e.g., SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, SEQ ID NO:512, SEQ ID NO:514, SEQ ID NO:516, SEQ ID NO:518, SEQ ID NO:520, SEQ ID NO:522, SEQ ID NO:524, SEQ ID NO:526, SEQ ID NO:528, SEQ ID NO:530, SEQ ID NO:532, SEQ ID NO:534, SEQ ID NO:536, SEQ ID NO:538, SEQ ID NO:540, SEQ ID NO:542, SEQ ID NO:544, SEQ ID NO:546, SEQ ID NO:548, SEQ ID NO:550, SEQ ID NO:552, SEQ ID NO:554, SEQ ID NO:556, SEQ ID NO:558, SEQ ID NO:560, SEQ ID NO:562, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:590, SEQ ID NO:592, SEQ ID NO:594, SEQ ID NO:596, SEQ ID NO:598, SEQ ID NO:600, SEQ ID NO:602, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:644, SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:680, SEQ ID NO:682, SEQ ID NO:684, SEQ ID NO:686, SEQ ID NO:688, SEQ ID NO:690, SEQ ID NO:692, SEQ ID NO:694, SEQ ID NO:696, SEQ ID NO:698, SEQ ID NO:700, SEQ ID NO:702, SEQ ID NO:704, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:722, SEQ ID NO:724, SEQ ID NO:726, SEQ ID NO:728, SEQ ID NO:730, SEQ ID NO:732, SEQ ID NO:734, SEQ ID NO:736, SEQ ID NO:738, SEQ ID NO:740, SEQ ID NO:742, SEQ ID NO:744, SEQ ID NO:746, SEQ ID NO:748, SEQ ID NO:750, SEQ ID NO:752, SEQ ID NO:754, SEQ ID NO:756, SEQ ID NO:758, SEQ ID NO:760, SEQ ID NO:762, SEQ ID NO:764, SEQ ID NO:766, SEQ ID NO:768, SEQ ID NO:770, SEQ ID NO:772, SEQ ID NO:774, SEQ ID NO:776, SEQ ID NO:778, SEQ ID NO:780, SEQ ID NO:782, SEQ ID NO:784, SEQ ID NO:786, SEQ ID NO:788, SEQ ID NO:790, SEQ ID NO:792, SEQ ID NO:794, SEQ ID NO:796, SEQ ID NO:798, SEQ ID NO:800, SEQ ID NO:802, SEQ ID NO:804, SEQ ID NO:808, SEQ ID NO:808, SEQ ID NO:810, SEQ ID NO:812, SEQ ID NO:814, SEQ ID NO:816, SEQ ID NO:818, SEQ ID NO:820, SEQ ID NO:822, SEQ ID NO:824, SEQ ID NO:826, SEQ ID NO:828, SEQ ID NO:830, SEQ ID NO:832, SEQ ID NO:834, SEQ ID NO:836, SEQ ID NO:838, SEQ ID NO:840, SEQ ID NO:842, SEQ ID NO:844, SEQ ID NO:846, SEQ ID NO:848, SEQ ID NO:850, SEQ ID NO:852, SEQ ID NO:854, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:886, SEQ ID NO:888, SEQ ID NO:890, SEQ ID NO:892, SEQ ID NO:894, SEQ ID NO:896, SEQ ID NO:898, SEQ ID NO:900, SEQ ID NO:902, SEQ ID NO:904, SEQ ID NO:906, SEQ ID NO:908, SEQ ID NO:910, SEQ ID NO:912, SEQ ID NO:914, SEQ ID NO:916, SEQ ID NO:918, SEQ ID NO:920, SEQ ID NO:922, SEQ ID NO:924, SEQ ID NO:926, SEQ ID NO:928, SEQ ID NO:930, SEQ ID NO:932, SEQ ID NO:934, SEQ ID NO:936, SEQ ID NO:938, SEQ ID NO:940, SEQ ID NO:942, SEQ ID NO:944, SEQ ID NO:946, SEQ ID NO:948, SEQ ID NO:950, SEQ ID NO:952 or SEQ ID NO:954. As discussed above, the identity can be over the full length of the polypeptide, or, the identity can be over a region of at least about 50, 60, 70, 80, 90, 100, 150, 200, 250, 300, 350, 400, 450, 500, 550, 600, 650, 700 or more residues. Polypeptides of the invention can also be shorter than the full length of exemplary polypeptides. In one aspect, the invention provides a polypeptide comprising only a subsequence of a sequence of the invention, exemplary subsequences can be about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues. In alternative aspects, the invention provides polypeptides (peptides, fragments) ranging in size between about 5 and the full length of a polypeptide, e.g., an enzyme, such as a hydrolase, including an esterase, an acylase, a lipase, a phospholipase or a protease; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary hydrolase of the invention. Peptides of the invention can be useful as, e.g., labeling probes, antigens, toleragens, motifs, hydrolase active sites. Polypeptides of the invention also include antibodies capable of binding to a hydrolase of the invention.

Additionally, the invention provides isolated, synthetic or recombinant polypeptides having a sequence identity (e.g., at least 50% sequence identity) to an exemplary sequence of the invention, e.g., SEQ ID NO:956, SEQ ID NO:958, SEQ ID NO: 960, SEQ ID NO:962, SEQ ID NO:964, SEQ ID NO:966, SEQ ID NO:968, SEQ ID NO:970, SEQ ID NO:972, SEQ ID NO:974, SEQ ID NO:976, SEQ ID NO:978, SEQ ID NO:980, SEQ ID NO:982, or SEQ ID NO:984.

The polypeptides of the invention include hydrolases in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include hydrolases inactive for other reasons, e.g., before "activation" by a post-translational processing event, e.g., an endo-or exo-peptidase or proteinase action, a phosphorylation event, an amidation, a glycosylation or a sulfation, a dimerization event, and the like. Methods for identifying "prepro" domain sequences and signal sequences are well known in the art, see, e.g., Van de Ven (1993) Crit. Rev. Oncog. 4(2): 115-136. For example, to identify a prepro sequence, the protein is purified from the extracellular space and the N-terminal protein sequence is determined and compared to the unprocessed form.

The polypeptides of the invention include all active forms, including active subsequences, e.g., catalytic domains or active sites, of an enzyme of the invention. In one aspect, the invention provides catalytic domains or active sites as set forth below. In one aspect, the invention provides a peptide or polypeptide comprising or consisting of an active site domain as predicted through use of a database such as Pfam (which is a large collection of multiple sequence alignments and hidden Markov models covering many common protein families, The Pfam protein families database, A. Bateman, E. Birney, L. Cerruti, R. Durbin, L. Etwiller, S. R. Eddy, S. Griffiths-Jones, K. L. Howe, M. Marshall, and E. L. L. Sonnhammer, Nucleic Acids Research, 30(1):276-280, 2002) or equivalent.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated or recombinant signal sequences, prepro sequences and catalytic domains (e.g., "active sites") comprising sequences of the invention.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has a hydrolase activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Teptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D-or L-naphylalanine; D-or L-phenylglycine; D-or L-2 thieneylalanine; D-or L-1, -2,3-, or 4-pyreneylalanine; D-or L-3 thieneylalanine; D-or L-(2-pyridinyl)-alanine; D-or L-(3-pyridinyl)-alanine; D-or L-(2-pyrazinyl)-alanine; D-or L-(4-isopropyl)-phenylglycine; D-(trifluoromethyl)-phenylglycine; D-(trifluoromethyl)-phenylalanine; D-p-fluoro-phenylalanine; D-or L-p-biphenylphenylalanine; D-or L-p-methoxy-biphenylphenylalanine; D-or L-2-indole(alkyl)alanines; and, D-or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl) carbodiimide or 1-ethyl-3(4-azonia-4, 4-dimetholpentyl)carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzenesulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3-or 4-hydroxy proline, dehydroproline, 3-or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R-or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptides, or fragments thereof, of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

Enzymes of the Invention

The invention provides novel hydrolases, including esterases, acylases, lipases, phospholipases or proteases, e.g., proteins comprising at least about 50% sequence identity to an exemplary polypeptide of the invention, e.g., a protein having a sequence as set forth in SEQ ID NO:2, SEQ ID NO:4, SEQ ID NO:6, SEQ ID NO:8, etc., antibodies that bind them, and methods for making and using them. The polypeptides of the invention can have any hydrolase activity, e.g., an esterase, acylase, lipase, phospholipase or protease activity. In alternative aspects, an activity of an enzyme of the invention comprises hydrolysis or synthesis of lipids or oils. The hydrolases of the invention can modify oils by hydrolysis, alcoholysis, esterification, transesterification and/or interesterification, including "forced migration" reactions.

In alternative aspects, the hydrolases of the invention can have modified or new activities as compared to the exemplary hydrolases or the activities described herein. For example, the invention includes hydrolases with and without signal sequences and the signal sequences themselves. The invention includes immobilized hydrolases, anti-hydrolase antibodies and fragments thereof. The invention provides proteins for inhibiting hydrolase activity, e.g., antibodies that bind to the hydrolase active site. The invention includes homodimers and heterocomplexes, e.g., fusion proteins, heterodimers, etc., comprising the hydrolases of the invention. The invention includes hydrolases having activity over a broad range of high and low temperatures and pH's (e.g., acidic and basic aqueous conditions).

In one aspect, one or more hydrolases (e.g., lipases) of the invention is used for the biocatalytic synthesis of structured lipids, i.e., lipids that contain a defined set of fatty acids distributed in a defined manner on the glycerol backbone, including cocoa butter alternatives, poly-unsaturated fatty acids (PUFAs), 1,3-diacyl glycerides (DAGs), 2-monoglycerides (MAGs) and triacylglycerides (TAGs).

In one aspect, the invention provides methods of generating enzymes having altered (higher or lower) $K_{cat}/K_m$. In one aspect, site-directed mutagenesis is used to create additional hydrolase enzymes with alternative substrate specificities. The can be done, for example, by redesigning the substrate binding region or the active site of the enzyme. In one aspect, hydrolases of the invention are more stable at high temperatures, such as 80° C. to 85° C. to 90° C. to 95° C., as compared to hydrolases from conventional or moderate organisms.

Various proteins of the invention have a hydrolase activity, e.g., an esterase, acylase, lipase, phospholipase or protease activity, under various conditions. The invention provides methods of making hydrolases with different catalytic efficiency and stabilities towards temperature, oxidizing agents and pH conditions. These methods can use, e.g., the techniques of site-directed mutagenesis and/or random mutagenesis. In one aspect, directed evolution can be used to produce hydrolases with alternative specificities and stability.

The proteins of the invention are used in methods of the invention that can identify hydrolase modulators, e.g., activators or inhibitors. Briefly, test samples (e.g., compounds, such as members of peptide or combinatorial libraries, broths, extracts, and the like) are added to hydrolase assays to determine their ability to modulate, e.g., inhibit or activate, substrate cleavage. These inhibitors can be used in industry and research to reduce or prevent undesired isomerization. Modulators found using the methods of the invention can be used to alter (e.g., decrease or increase) the spectrum of activity of a hydrolase.

The invention also provides methods of discovering hydrolases using the nucleic acids, polypeptides and antibodies of the invention. In one aspect, lambda phage libraries are screened for expression-based discovery of hydrolases. In one aspect, the invention uses lambda phage libraries in screening to allow detection of toxic clones; improved access to substrate; reduced need for engineering a host, by-passing the potential for any bias resulting from mass excision of the library; and, faster growth at low clone densities. Screening of lambda phage libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention involving robotic automation. This enables the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks.

The invention includes hydrolase enzymes which are non-naturally occurring hydrolases having a different hydrolase activity, stability, substrate specificity, pH profile and/or performance characteristic as compared to the non-naturally occurring hydrolase. These hydrolases have an amino acid sequence not found in nature. They can be derived by substitution of a plurality of amino acid residues of a precursor hydrolase with different amino acids. The precursor hydrolase may be a naturally-occurring hydrolase or a recombinant hydrolase. In one aspect, the hydrolase variants encompass the substitution of any of the naturally occurring L-amino acids at the designated amino acid residue positions.

Hydrolase Signal Sequences, Prepro and Catalytic Domains

The invention provides signal sequences (e.g., signal peptides (SPs)), prepro domains and catalytic domains (CDs). The SPs, prepro domains and/or CDs of the invention can be isolated or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention). In one aspect, the invention provides a signal sequence comprising a peptide comprising/consisting of a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44 (or a longer peptide) of a polypeptide of the invention.

The hydrolase signal sequences (SPs), CDs, and/or prepro sequences of the invention can be isolated peptides, or, sequences joined to another hydrolase or a non-hydrolase polypeptide, e.g., as a fusion (chimeric) protein. In one aspect, the invention provides polypeptides comprising hydrolase signal sequences of the invention. In one aspect, polypeptides comprising hydrolase signal sequences SPs, CDs, and/or prepro of the invention comprise sequences heterologous to hydrolases of the invention (e.g., a fusion protein comprising an SP, CD, and/or prepro of the invention and sequences from another hydrolase or a non-hydrolase protein). In one aspect, the invention provides hydrolases of the invention with heterologous SPs, CDs, and/or prepro sequences, e.g., sequences with a yeast signal sequence. A hydrolase of the invention can comprise a heterologous SP and/or prepro in a vector, e.g., a pPIC series vector (Invitrogen, Carlsbad, Calif.).

In one aspect, SPs, CDs, and/or prepro sequences of the invention are identified following identification of novel hydrolase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. The signal sequences can vary in length from 13 to 45 or more amino acid residues. Various methods of recognition of signal sequences are known to those of skill in the art. For example, in one aspect, novel hydrolase signal peptides are identified by a method referred to as SignalP. SignalP uses a combined neural network which recognizes both signal peptides and their cleavage sites. (Nielsen, et al., "Identification of prokaryotic and eukaryotic signal peptides and prediction of their cleavage sites." Protein Engineering, vol. 10, no. 1, p. 1-6 (1997).

It should be understood that in some aspects hydrolases of the invention may not have SPs and/or prepro sequences, and/or catalytic domains (CDs). In one aspect, the invention provides polypeptides (e.g., hydrolases) lacking all or part of an SP, a CD and/or a prepro domain. In one aspect, the invention provides a nucleic acid sequence encoding a signal sequence (SP), a CD, and/or prepro from one hydrolase operably linked to a nucleic acid sequence of a different hydrolase or, optionally, a signal sequence (SPs) and/or prepro domain from a non-hydrolase protein may be desired.

The invention also provides isolated or recombinant polypeptides comprising signal sequences (SPs), prepro domain and/or catalytic domains (CDs) of the invention and heterologous sequences. The heterologous sequences are sequences not naturally associated (e.g., to a hydrolase) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., hydrolase sequence). Similarly in one aspect, the invention provides isolated or recombinant nucleic acids encoding these polypeptides. Thus, in one aspect, the isolated or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

The invention provides fusion of N-terminal or C-terminal subsequences of enzymes of the invention (e.g., signal sequences, prepro sequences) with other polypeptides, active proteins or protein fragments. The production of an enzyme of the invention (e.g., a hydrolase, e.g., a lipase such as a phospholipase) may also be accomplished by expressing the enzyme as an inactive fusion protein that is later activated by a proteolytic cleavage event (using either an endogenous or exogenous protease activity, e.g. trypsin) that results in the separation of the fusion protein partner and the mature enzyme, e.g., hydrolase of the invention. In one aspect, the fusion protein of the invention is expressed from a hybrid nucleotide construct that encodes a single open reading frame containing the following elements: the nucleotide sequence for the fusion protein, a linker sequence (defined as a nucleotide sequence that encodes a flexible amino acid sequence that joins two less flexible protein domains), protease cleavage recognition site, and the mature enzyme (e.g., any enzyme of the invention, e.g., a hydrolase) sequence. In alternative aspects, the fusion protein can comprise a pectate lyase sequence, a xylanase sequence, a phosphatidic acid phosphatase sequence, or another sequence, e.g., a sequence that has previously been shown to be over-expressed in a host system of interest. Any host system can be used (see discussion, above), for example, *E. coli* or *Pichia pastoris*. The arrangement of the nucleotide sequences in the chimeric nucleotide construction can be determined based on the protein expression levels achieved with each fusion construct. Proceeding from the 5' end of the nucleotide construct to the 3' prime end of the construct, in one aspect, the nucleotide sequences is assembled as follows: Signal sequence/fusion protein/linker sequence/protease cleavage recognition site/mature enzyme (e.g., any enzyme of the invention, e.g., a hydrolase) or Signal sequence/pro sequence/mature enzyme/linker sequence/fusion protein. The expression of enzyme (e.g., any enzyme of the invention, e.g., a hydrolase) as an inactive fusion protein may improve the overall expression of the enzyme's sequence, may reduce any potential toxicity associated with the overproduction of active enzyme and/or may increase the shelf life of enzyme prior to use because enzyme would be inactive until the fusion protein e.g. pectate lyase is separated from the enzyme, e.g., hydrolase of the invention.

In various aspects, the invention provides specific formulations for the activation of a hydrolase of the invention expressed as a fusion protein. In one aspect, the activation of the hydrolase activity initially expressed as an inactive fusion protein is accomplished using a proteolytic activity or potentially a proteolytic activity in combination with an amino-terminal or carboxyl-terminal peptidase (the peptidase can be an enzyme of the invention, or, another enzyme). This activation event may be accomplished in a variety of ways and at variety of points in the manufacturing/storage process prior to application in oil degumming. Exemplary processes of the invention include: Cleavage by an endogenous activity expressed by the manufacturing host upon secretion of the fusion construct into the fermentation media; Cleavage by an endogenous protease activity (which can be a protease of the invention) that is activated or comes in contact with intracellularly expressed fusion construct upon rupture of the host cells; Passage of the crude or purified fusion construct over a column of immobilized protease (which can be a protease of the invention) activity to accomplish cleavage and enzyme (e.g., hydrolase of the invention, e.g., a protease, lipase, esterase or phospholipase) activation prior to enzyme formulation; Treatment of the crude or purified fusion construct with a soluble source of proteolytic activity; Activation of a hydrolase (e.g., a hydrolase of the invention) at the oil refinery using either a soluble or insoluble source of proteolytic activity immediately prior to use in the process; and/or, Activation of the hydrolase (e.g., hydrolase of the invention) activity by continuously circulating the fusion construct formulation through a column of immobilized protease activity at reduced temperature (for example, any between about 4° C. and 20° C.). This activation event may be accomplished prior to delivery to the site of use or it may occur on-site at the oil refinery.

Glycosylation

The peptides and polypeptides of the invention (e.g., hydrolases, antibodies) can also be glycosylated, for example, in one aspect, comprising at least one glycosylation site, e.g., an N-linked or O-linked glycosylation. In one aspect, the polypeptide can be glycosylated after being expressed in a *P. pastoris* or a *S. pombe*. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence.

Assays for Phospholipase Activity

The invention provides isolated or recombinant polypeptides having a phospholipase activity and nucleic acids encoding them. Any of the many phospholipase activity assays known in the art can be used to determine if a polypeptide has a phospholipase activity and is within the scope of the invention. Routine protocols for determining phospholipase A, B, D and C, patatin and lipid acyl hydrolase activities are well known in the art.

Exemplary activity assays include turbidity assays, methylumbelliferyl phosphocholine (fluorescent) assays, Amplex red (fluorescent) phospholipase assays, thin layer chromatography assays (TLC), cytolytic assays and p-nitrophenylphosphorylcholine assays. Using these assays polypeptides can be quickly screened for phospholipase activity.

The phospholipase activity can comprise a lipid acyl hydrolase (LAH) activity. See, e.g., Jimenez (2001) Lipids 36:1169-1174, describing an octaethylene glycol monododecyl ether-based mixed micellar assay for determining the lipid acyl hydrolase activity of a patatin. Pinsirodom (2000) J. Agric. Food Chem. 48:155-160, describes an exemplary lipid acyl hydrolase (LAH) patatin activity.

Turbidity assays to determine phospholipase activity are described, e.g., in Kauffmann (2001) "Conversion of *Bacillus thermocatenulatus* lipase into an efficient phospholipase with increased activity towards long-chain fatty acyl substrates by directed evolution and rational design," Protein Engineering 14:919-928; Ibrahim (1995) "Evidence implicating phospholipase as a virulence factor of *Candida albicans*," Infect. Immun. 63:1993-1998.

Methylumbelliferyl (fluorescent) phosphocholine assays to determine phospholipase activity are described, e.g., in Goode (1997) "Evidence for cell surface and internal phospholipase activity in ascidian eggs," Develop. Growth Differ. 39:655-660; Diaz (1999) "Direct fluorescence-based lipase activity assay," BioTechniques 27:696-700.

Amplex Red (fluorescent) Phospholipase Assays to determine phospholipase activity are available as kits, e.g., the detection of phosphatidylcholine-specific phospholipase using an Amplex Red phosphatidylcholine-specific phospholipase assay kit from Molecular Probes Inc. (Eugene, Oreg.), according to manufacturer's instructions. Fluorescence is measured in a fluorescence microplate reader using excitation at 560±10 nm and fluorescence detection at 590±10 nm. The assay is sensitive at very low enzyme concentrations.

Thin layer chromatography assays (TLC) to determine phospholipase activity are described, e.g., in Reynolds (1991) Methods in Enzymol. 197:3-13; Taguchi (1975) "Phospholipase from *Clostridium novyi* type A.I," Biochim. Biophys. Acta 409:75-85. Thin layer chromatography (TLC) is a widely used technique for detection of phospholipase activity. Various modifications of this method have been used to extract the phospholipids from the aqueous assay mixtures. In some PLC assays the hydrolysis is stopped by addition of chloroform/methanol (2:1) to the reaction mixture. The unreacted starting material and the diacylglycerol are extracted into the organic phase and may be fractionated by TLC, while the head group product remains in the aqueous phase. For more precise measurement of the phospholipid digestion, radiolabeled substrates can be used (see, e.g., Reynolds (1991) Methods in Enzymol. 197:3-13). The ratios of products and reactants can be used to calculate the actual number of moles of substrate hydrolyzed per unit time. If all the components are extracted equally, any losses in the extraction will affect all components equally. Separation of phospholipid digestion products can be achieved by silica gel TLC with chloroform/methanol/water (65:25:4) used as a solvent system (see, e.g., Taguchi (1975) Biochim. Biophys. Acta 409:75-85).

p-Nitrophenylphosphorylcholine assays to determine phospholipase activity are described, e.g., in Korbsrisate (1999) J. Clin. Microbiol. 37:3742-3745; Berka (1981) Infect. Immun. 34:1071-1074. This assay is based on enzymatic hydrolysis of the substrate analog p-nitrophenylphosphorylcholine to liberate a yellow chromogenic compound p-nitrophenol, detectable at 405 nm. This substrate is convenient for high-throughput screening.

A cytolytic assay can detect phospholipases with cytolytic activity based on lysis of erythrocytes. Toxic phospholipases can interact with eukaryotic cell membranes and hydrolyze phosphatidylcholine and sphingomyelin, leading to cell lysis. See, e.g., Titball (1993) Microbiol. Rev. 57:347-366.

Hybrid Hydrolases and Peptide Libraries

In one aspect, the invention provides hybrid hydrolases and fusion proteins, including peptide libraries, comprising sequences of the invention. The peptide libraries of the invention can be used to isolate peptide modulators (e.g., activators or inhibitors) of targets. The peptide libraries of the invention can be used to identify formal binding partners of targets, such as ligands, e.g., cytokines, hormones and the like.

In one aspect, the fusion proteins of the invention (e.g., the peptide moiety) are conformationally stabilized (relative to linear peptides) to allow a higher binding affinity for targets. The invention provides fusions of hydrolases of the invention and other peptides, including known and random peptides. They can be fused in such a manner that the structure of the hydrolases are not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g, an allelic or interspecies variation of a hydrolase sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed hydrolase variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using assays of proteolytic activities. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides hydrolases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example an alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. hydrolase activity) although variants can be selected to modify the characteristics of the hydrolases as needed.

In one aspect, hydrolases of the invention comprise epitopes or purification tags, signal sequences or other fusion sequences, etc. In one aspect, the hydrolases of the invention can be fused to a random peptide to form a fusion polypeptide. By "fused" or "operably linked" herein is meant that the random peptide and the hydrolase are linked together, in such a manner as to minimize the disruption to the stability of the hydrolase structure, e.g., it retains hydrolase activity. The fusion polypeptide (or fusion polynucleotide encoding the fusion polypeptide) can comprise further components as well, including multiple peptides at multiple loops.

In one aspect, the peptides (e.g., hydrolase subsequences) and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for hydrolase activity, to screen compounds as potential activators or inhibitors of a hydrolase activity (e.g., for potential drug screening), for antibodies that bind to a polypeptide of the invention, for nucleic acids that hybridize to a nucleic acid of the invention, to screen for cells expressing a polypeptide of the invention and the like. See, e.g., U.S. Pat. No. 6,337,187.

Capillary Arrays

Capillary arrays, such as the GIGAMATRIX™, Diversa Corporation, San Diego, Calif., can be used to in the methods of the invention. Nucleic acids or polypeptides of the invention can be immobilized to or applied to an array, including capillary arrays. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays provide another system for holding and screening samples. For example, a sample screening apparatus can include a plurality of capillaries formed into an array of adjacent capillaries, wherein each capillary comprises at least one wall defining a lumen for retaining a sample. The apparatus can further include interstitial material disposed between adjacent capillaries in the array, and one or more reference indicia formed within of the interstitial material. A capillary for screening a sample, wherein the capillary is adapted for being bound in an array of capillaries, can include a first wall defining a lumen for retaining the sample, and a second wall formed of a filtering material, for filtering excitation energy provided to the lumen to excite the sample.

A polypeptide or nucleic acid, e.g., a ligand or a substrate, can be introduced into a first component into at least a portion of a capillary of a capillary array. Each capillary of the capillary array can comprise at least one wall defining a lumen for retaining the first component. An air bubble can be introduced into the capillary behind the first component. A second component can be introduced into the capillary, wherein the second component is separated from the first component by the air bubble. A sample of interest can be introduced as a first liquid labeled with a detectable particle into a capillary of a capillary array, wherein each capillary of the capillary array comprises at least one wall defining a lumen for retaining the first liquid and the detectable particle, and wherein the at least one wall is coated with a binding material for binding the detectable particle to the at least one wall. The method can further include removing the first liquid from the capillary tube, wherein the bound detectable particle is maintained within the capillary, and introducing a second liquid into the capillary tube.

The capillary array can include a plurality of individual capillaries comprising at least one outer wall defining a lumen. The outer wall of the capillary can be one or more walls fused together. Similarly, the wall can define a lumen that is cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. The capillary array can be formed of any number of individual capillaries, for example, a range from 100 to 4,000,000 capillaries. A capillary array can form a micro titer plate having about 100,000 or more individual capillaries bound together.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a hydrolase gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

In one aspect, the hydrolases are used as immobilized forms. Any immobilization method can be used, e.g., immobilization upon an inert support such as diethylaminoethyl-cellulose, porous glass, chitin or cells. Cells that express hydrolases of the invention can be immobilized by cross-linking, e.g. with glutaraldehyde to a substrate surface.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated or recombinant antibodies that specifically bind to a hydrolase of the invention. These antibodies can be used to isolate, identify or quantify the hydrolase of the invention or related polypeptides. These antibodies can be used to isolate other polypeptides within the scope the invention or other related hydrolases.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, N.Y. (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

Polypeptides or peptides can be used to generate antibodies, which bind specifically to the polypeptides of the invention. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the invention.

In immunoaffinity procedures, the antibody is attached to a solid support, such as a bead or other column matrix. The protein preparation is placed in contact with the antibody under conditions in which the antibody specifically binds to one of the polypeptides of the invention. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays, and Western Blots.

Polyclonal antibodies generated against the polypeptides of the invention can be obtained by direct injection of the polypeptides into an animal or by administering the polypeptides to a non-human animal. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique, the trioma technique, the human B-cell hybridoma technique, and the EBV-hybridoma technique (see, e.g., Cole (1985) in Monoclonal Antibodies and Cancer Therapy, Alan R. Liss, Inc., pp. 77-96).

Techniques described for the production of single chain antibodies (see, e.g., U.S. Pat. No. 4,946,778) can be adapted to produce single chain antibodies to the polypeptides of the invention. Alternatively, transgenic mice may be used to express humanized antibodies to these polypeptides or fragments thereof.

Antibodies generated against the polypeptides of the invention (including anti-idiotype antibodies) may be used in screening for similar polypeptides from other organisms and samples. In such techniques, polypeptides from the organism are contacted with the antibody and those polypeptides which specifically bind the antibody are detected. Any of the procedures described above may be used to detect antibody binding.

Immobilized Hydrolases

In one aspect, the hydrolase of the invention, e.g., esterases, acylases, lipases, phospholipases or proteases, are used as immobilized forms, e.g., to process lipids, in the structured synthesis of lipids, to digest proteins and the like. The immobilized lipases of the invention can be used, e.g., for hydrolysis of triglycerides, diglycerides or esters or for the esterification or transesterification of fatty acids, diglycerides or triglycerides, or in the interesterification of fats. In one aspect, the lipase is specific for esterification of fatty acids with alcohol, 1,3-specific or randomizing transesterification lipase or lipase specific for the hydrolysis of partial glycerides, esters or triglycerides. Immobilized lipase of the invention can be used in a packed bed for continuous transesterification of solvent free fats. See, e.g., U.S. Pat. Nos. 4,818,695; 5,569,594.

Any immobilization method or form of support can be used, e.g., arrays, beads, capillary supports and the like, as described above; In one aspect, hydrolase immobilization can occur upon an inert support such as diethylaminoethyl-cellulose, porous glass, chitin or cells. Cells that express hydrolases of the invention can be immobilized by cross-linking, e.g. with glutaraldehyde to a substrate surface. Immobilized hydrolases of the invention can be prepared containing hydrolase bound to a dry, porous particulate hydrophobic support, with a surfactant, such as a polyoxyethylene sorbitan fatty acid ester or a polyglycerol fatty acid ester. The support can be an aliphatic olefinic polymer, such as a polyethylene or a polypropylene, a homo-or copolymer of styrene or a blend thereof or a pre-treated inorganic support. These supports can be selected from aliphatic olefinic polymers, oxidation polymers, blends of these polymers or pre-treated inorganic supports in order to make these supports hydrophobic. This pretreatment can comprise silanization with an organic silicon compound. The inorganic material can be a silica, an alumina, a glass or a ceramic. Supports can be made from polystyrene, copolymers of styrene, polyethylene, polypropylene or from co-polymers derived from (meth)acrylates. See, e.g., U.S. Pat. No. 5,773,266.

Kits

The invention provides kits comprising the compositions, e.g., nucleic acids, expression cassettes, vectors, cells, transgenic seeds or plants or plant parts, polypeptides (e.g., hydrolases) and/or antibodies of the invention. The kits also can contain instructional material teaching the methodologies and industrial uses of the invention, as described herein.

Measuring Metabolic Parameters

The methods of the invention provide whole cell evolution, or whole cell engineering, of a cell to develop a new cell strain having a new phenotype by modifying the genetic composition of the cell, where the genetic composition is modified by addition to the cell of a nucleic acid, e.g., a hydrolase-encoding nucleic acid of the invention. To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the fluorescent polypeptides of the invention (e.g., hydrolases of the invention comprising a fluorescent moiety).

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript or generating new transcripts in a cell. This increased or decreased expression can be traced by use of a hydrolase-encoding nucleic acid of the invention. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis-or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide or generating new polypeptides in a cell. This increased or decreased expression can be traced by use of a hydrolase or an antibody of the invention. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immuno-fluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial and Medical Applications

The invention provides many industrial uses and medical applications for the hydrolases (e.g., lipases, phospholipases, esterases, proteases) of the invention, and a few exemplary uses and compositions of the invention are described below. The processes of the invention comprise converting a non-hydratable phospholipid to a hydratable form, oil degumming, food processing, processing of oils from plants, fish, algae and the like, to name just a few applications.

Phospholipases

The invention provides many industrial uses and medical applications for the hydrolases, e.g., lipases and phospholipases of the invention, e.g., phospholipases A, B, C and D. Methods of using phospholipase enzymes in industrial applications are well known in the art. For example, the phospholipases and methods of the invention can be used for the processing of fats and oils as described, e.g., in JP Patent Application Publication H6-306386, describing converting phospholipids present in the oils and fats into water-soluble substances containing phosphoric acid groups.

Phospholipases of the invention can be used to process plant oils and phospholipids such as those derived from or isolated from rice bran, soy, canola, palm, cottonseed, corn, palm kernel, coconut, peanut, sesame, sunflower. Phospholipases of the invention can be used to process essential oils, e.g., those from fruit seed oils, e.g., grapeseed, apricot, borage, etc. Phospholipases of the invention can be used to process oils and phospholipids in different forms, including crude forms, degummed, gums, wash water, clay, silica, soapstock, and the like. The phospholipids of the invention can be used to process high phosphorous oils, fish oils, animal oils, plant oils, algae oils and the like. In any aspect of the invention, any time a phospholipase C can be used, an alternative comprises use of a phospholipase D of the invention and a phosphatase (e.g., using a PLD/phosphatase combination to improve yield in a high phosphorus oil, such as a soy bean oil).

In one aspect, the invention provides compositions and methods (which can comprise use of phospholipases of the invention) for oil degumming comprising using varying amounts of acid and base without making soapstock. Using this aspect of the invention for oil degumming, acid (including phosphoric and/or citric) can be used to hydrate non-hydratable phospholipids in high phosphorous oils (including, e.g., rice bran, soybean, canola, and sunflower). Once the phospholipids are hydrated, the pH of the aqueous phase can be raised using caustic addition: the amount of caustic added can create a favorable pH for enzyme activity but will not result in the formation of a significant soapstock fraction in the oil. Because a soapstock is not formed, the free fatty acids in the oil can be removed downstream, following the degumming step, during bleaching and deodorization.

Phospholipases of the invention can be used to process and make edible oils, biodiesel oils, liposomes for pharmaceuticals and cosmetics, structured phospholipids and structured lipids. Phospholipases of the invention can be used in oil extraction. Phospholipases of the invention can be used to process and make various soaps.

The phospholipases of the invention can also be used to study the phosphoinositide (PI) signaling system; in the diagnosis, prognosis and development of treatments for bipolar disorders (see, e.g., Pandey (2002) Neuropsychopharmacology 26:216-228); as antioxidants; as modified phospholipids; as foaming and gelation agents; to generate angiogenic lipids for vascularizing tissues; to identify phospholipase, e.g., PLA, PLB, PLC, PLD and/or patatin modulators (agonists or antagonists), e.g., inhibitors for use as anti-neoplastics, anti-inflammatory and as analgesic agents. They can be used to generate acidic phospholipids for controlling the bitter taste in food and pharmaceuticals. They can be used in fat purification. They can be used to identify peptides inhibitors for the treatment of viral, inflammatory, allergic and cardiovascular diseases. They can be used to make vaccines. They can be used to make polyunsaturated fatty acid glycerides and phosphatidylglycerols.

The phospholipases of the invention, for example PLA and PLC enzymes, are used to generate immunotoxins and various therapeutics for anti-cancer treatments.

The phospholipases of the invention can be used in conjunction with other enzymes for decoloring (i.e. chlorophyll removal) and in detergents (see above), e.g., in conjunction with other enzymes (e.g., lipases, proteases, esterases, phosphatases). For example, in any instance where a PLC is used, a PLD and a phosphatase may be used in combination, to produce the same result as a PLC alone.

Detoxification

The hydrolases (e.g., lipases, esterase, protease and/or phospholipases of the invention) can be used in detoxification processes, e.g., for the detoxification of endotoxins, e.g., compositions comprising lipopolysaccharides (LPS), and, the invention provides detoxification processes using at least one enzyme of the invention, e.g., a hydrolase having a sequence as set forth in SEQ ID NO:962 (encoded by SEQ ID NO:961), or SEQ ID NO:966 (encoded by SEQ ID NO:965). In one aspect, a lipase and/or an esterase of the invention is used to detoxify a lipopolysaccharide (LPS). In one aspect, this detoxification is by deacylation of 2' and/or 3' fatty acid chains from lipid A. In one aspect, a hydrolase (e.g., a lipase and/or an esterase) of the invention is used to hydrolyze a 2'-lauroyl and/or a 3'-myristoyl chain from a lipid, e.g., a lipid A (e.g., from a bacterial endotoxin). In one aspect, the process of the invention is used to destroy an endotoxin, e.g., a toxin from a gram negative bacteria, as from *E. coli*. In one aspect, a hydrolase (e.g., a lipase and/or an esterase) of the invention is used to ameliorate the effects of toxin poisoning (e.g., from an on-going gram negative infection), or, to prophylactically to prevent the effects of endotoxin during an infection (e.g., an infection in an animal or a human). Accordingly, the invention provides a pharmaceutical composition comprising a hydrolase (e.g., a lipase and/or an esterase) of the invention, and method using a hydrolase of the invention, for the amelioration or prevention of lipopolysaccharide (LPS) toxic effects, e.g., during sepsis.

Processing Foods

The hydrolases, e.g., lipases, esterases, proteases and/or phospholipases of the invention, or a combination thereof, can be used to process foods, e.g., to change their stability, shelf-life, flavor, texture and the like. For example, in one aspect, phospholipases of the invention are used to generate acidic phospholipids for controlling bitter taste in foods.

In one aspect, the invention provides cheese-making processes using hydrolases (e.g., lipases, esterases, proteases, phospholipases) of the invention (and, thus, the invention also provides cheeses comprising hydrolases of the invention). In one aspect, the enzymes of the invention (e.g., lipases, esterases, proteases, phospholipases, e.g., phospholipase A, lysophospholipase or a combination thereof) are used to process cheeses for flavor enhancement, to increase yield and/or for "stabilizing" cheeses, e.g., by reducing the tendency for "oil-off," or, in one aspect, the enzymes of the invention are used to produce cheese from cheese milk. These processes of the invention can incorporate any method or protocol, e.g., as described, e.g., in U.S. Pat. Nos. 6,551,635, and 6,399,121, WO 03/070013, WO 00/054601. For example, in one aspect, hydrolases (e.g., lipases, esterases, proteases and/or phospholipases) of the invention are used to stabilize fat emulsion in milk or milk-comprising compositions, e.g. cream, and are used to stabilize milk compositions, e.g. for the manufacturing of creams or cream liquors. In one aspect, the invention provides a process for enhancing the favor of a cheese using at least one enzyme of the invention, the process comprising incubating a protein, a fat and a protease (e.g., of the invention) and a lipase (e.g., of the invention) in an aqueous medium under conditions that produce an enhanced cheese flavor (e.g., reduced bitterness), e.g., as described in WO 99/66805. In one aspect, phospholipases of the invention are used to enhance flavor in a cheese (e.g., a curd) by mixing with water, a protease (e.g., of the invention), and a lipase (e.g., of the invention) at an elevated temperature, e.g., between about 75° C. to 95° C., as described, e.g., in U.S. Pat. No. 4,752,483. In one aspect, phospholipases of the invention are used to accelerate cheese aging by adding an enzyme of the invention to a cheese (e.g., a cheese milk) before adding a coagulant to the milk, or, adding an enzyme (e.g., a lipase or a phospholipase) of the invention to a curd with salt before pressing, e.g., as described, e.g., in U.S. Pat. No. 4,707,364. In one aspect, a lipase of the invention is used degrade a triglyceride in milk fat to liberate free fatty acids, resulting in flavor enhancement. A protease of the invention also can be used in any of these processes of the invention, see, e.g., Brindisi (2001) J. of Food Sci. 66:1100-1107.

In one aspect, a hydrolase (e.g., lipases, esterase, protease and/or phospholipase of the invention) is used to reduce the content of phosphorus components in a food, e.g., an oil, such as a vegetable oil having a high non-hydratable phosphorus content, e.g., as described in WO 98/26057.

Caustic Refining

In one aspect, enzymes of the invention, e.g., phospholipases, lipases, esterases, proteases, are used as caustic refining aids. In one aspect, a PLC or PLD of the invention and a phosphatase are used in the processes as a drop-in, either before, during, or after a caustic neutralization refining process (either continuous or batch refining. The amount of enzyme added may vary according to the process. The water level used in the process should be low, e.g., about 0.5 to 5%. Alternatively, caustic is be added to the process multiple times. In addition, the process may be performed at different temperatures (25° C. to 70° C.), with different acids or caustics, and at varying pH (4-12). Acids that may be used in a caustic refining process include, but are not limited to, phosphoric, citric, ascorbic, sulfuric, fumaric, maleic, hydrochloric and/or acetic acids. Acids are used to hydrate non-hydratable phospholipids. Caustics that may be used include, but are not limited to, KOH— and NaOH. Caustics are used to neutralize free fatty acids. Alternatively, phospholipases of the invention, or more particularly a PLC or a PLD of the invention and a phosphatase, are used for purification of phytosterols from the gum/soapstock.

An alternate embodiment of the invention to add a phospholipase of the invention before caustic refining, e.g., by expressing the phospholipase in a plant. In another embodiment, the phospholipase of the invention is added during crushing of the plant, seeds or other plant part. Alternatively, the phospholipase of the invention is added following crushing, but prior to refining (i.e. in holding vessels). In addition, phospholipase is added as a refining pre-treatment, either with or without acid.

Another embodiment of the invention comprises adding a phospholipase of the invention during a caustic refining process. Levels of acid and caustic can be varied depending on the level of phosphorous and the level of free fatty acids. Broad temperature and pH ranges can be used in the process dependent upon the type of enzyme used.

In another embodiment of the invention, the phospholipase of the invention is added after caustic refining. In one aspect, the phospholipase is added in an intense mixer or in a retention mixer, prior to separation. Alternatively, the phospholipase is added following the heat step. In another embodiment, the phospholipase of the invention is added in the centrifugation step. In an additional embodiment, the phospholipase is added to the soapstock. Alternatively, the phospholipase is added to the washwater. In another instance, the phospholipase of the invention is added during the bleaching and/or deodorizing steps.

Structured Synthesis and Processing of Oils

The invention provides methods for the structured synthesis of oils, lipids and the like using hydrolases (e.g., lipases, phospholipases, esterases, proteases) of the invention. The methods of the invention comprise a biocatalytic synthesis of structured lipids, i.e., lipids that contain a defined set of fatty acids distributed in a defined manner on a backbone, e.g., a glycerol backbone. Products generated using the hydrolases of the invention and practicing the methods of the invention include cocoa butter alternatives, lipids containing poly-unsaturated fatty acids (PUFAs), 1,3-diacyl glycerides (DAGs), 2-monoacylglycerides (MAGs) and triacylglycerides (TAGs). The methods of the invention enable synthesis of lipids or fatty acids with defined regiospecificities and stereoselectivities.

The invention provides methods for processing (modifying) oils, lipids and the like using hydrolases of the invention. The methods of the invention can be used to process oils from plants, animals, microorganisms. The methods of the invention can be used in the structured synthesis of oils similar to those found in plants, animals, microorganisms. Lipids and oils can be processed to have a desired characteristic. Lipids and oils that can be processed by the methods of the invention (using the hydrolases of the invention) include cocoa butter alternatives, lipids containing poly-unsaturated fatty acids (PUFAs), 1,3-diacyl glycerides (DAGs), 2-monoacylglycerides (MAGs) and triacylglycerides (TAGs). In one aspect, the processed and synthetic oils and fats of the invention (e.g., cocoa butters alternatives and vegetable oils) can be used in a variety of applications, e.g., in the production of foods (e.g., confectionaries, pastries) and in the formulation of pharmaceuticals, nutraceuticals and cosmetics. In one aspect, the invention provides methods of processing fats and oils, e.g., oilseeds, from plants, including, e.g., rice bran, canola, sunflower, olive, palm, soy or lauric type oils using a hydrolase, e.g., a lipase, esterase or phospholipase, of the invention.

In one aspect, the invention provides methods of processing oils from animals, e.g., fish and mammals, using the hydrolases of the invention. In one aspect, the invention provides methods for the structured synthesis of oils similar to those found in animals, e.g., fish and mammals and microorganisms, using the hydrolases of the invention. In one aspect, these synthetic or processes oils are used as feed additives, foods, as ingredients in pharmaceutical formulations, nutraceuticals or in cosmetics. For example, in one aspect the hydrolases of the invention are used to make fish oil fatty acids as a feed additive. In one aspect, the hydrolases of the invention can be used to process oil from restaurant waste and rendered animal fats.

In one aspect, the hydrolases of the invention are versatile biocatalysts in organic synthesis, e.g., in the structured synthesis of oils, lipids and the like. Enzymes of the invention (including, e.g., esterases such as carboxyl esterases and lipases) can accept a broad range of substrates, including secondary and tertiary alcohols, e.g., from a natural product such as alpha-terpineol, linalool and the like. In some aspects, the hydrolases of the invention have good to excellent enantiospecificity (e.g., stereospecificity).

In one aspect, the hydrolase of the invention comprises a GGGX motif. As discussed above, in one aspect, the invention provides a fragment or subsequence of an enzyme of the invention comprising a catalytic domain ("CD") or "active site." In one aspect, a catalytic domain ("CD") or "active site" comprising peptide, catalytic antibody or polypeptide of the invention comprises a GGGX motif. In one aspect, this motif is located on a protein loop near the binding site of the substrate ester's carboxylic group. In one aspect, the GGGX motif is involved in the formation of an "oxyanion hole" which stabilizes the anionic carbonyl oxygen of a tetrahedral intermediate during the catalytic cycle of ester hydrolysis. In one aspect, the invention provides an esterase or a lipase comprising a GGGX motif for the hydrolysis of a tertiary alcohol ester. In one aspect, the invention provides an esterase or a lipase for the hydrolysis of a terpinyl-, linalyl, 2-phenyl-3-butin-2-yl acetate and/or a 3-methyl-1-pentin-3-yl-acetate, wherein the enzyme of the invention comprises a GGGX motif.

In one aspect, the invention provides an oil (e.g., vegetable oils, cocoa butters, and the like) conversion process comprising at least one enzyme (e.g., a lipase) of the invention. In one aspect, an oil conversion process comprises a controlled hydrolysis and acylation, e.g., a glycerol acylation, which can result in high purity and a broad end of products. In one aspect, hydrolases (e.g., lipases) of the invention are used to produce diacylglycerol oils and structured nutritional oils. In one aspect, the invention provides processes for the esterification of propylene glycol using an enzyme of the invention, e.g., a regio-and/or chemo-selective lipase for mono-substituted esterification at the sn-1 position. In one aspect, the invention provides processes for the structured synthesis of oils with targeted saturated or unsaturated fatty acid profiles using an enzyme of the invention, e.g., a regio-and/or chemo-selective lipase for the removal of a saturated fatty acid, or, for the targeted addition of a fatty acid to a glycerol backbone. In one aspect, the invention provides processes for modifying saturated fatty acids using an enzyme of the invention, e.g., by adding double bonds using an enzyme with desaturase activity (in one aspect, this process is done in whole cell systems). In one aspect, the invention provides processes for modifying saturated fatty acids using an enzyme of the invention, e.g., by the removal double bonds using enzymes with hydrogenation and/or dehydrogenation activity (in one aspect, this process is done in whole cell systems). In one aspect, the invention provides processes for the total hydrolysis of triglycerides without trans-isomer formation using an enzyme of the invention, e.g., a non-selective lipase of the invention for total hydrolysis without formation of trans-isomers. In one aspect, the invention provides processes for enzyme catalyzed monoesterification of a glycol, e.g., a propylene glycol, using a hydrolase (e.g., a lipase, an esterase) of the invention. In one aspect, oleic, linoleic or alpha-linolenic acids are used in the enzyme catalyzed monoesterification. Any oil, e.g., a vegetable oil such as soy, cotton, corn, rice bran or sunflower can be used in this process. The enzyme can be chemoselective and/or enantioselective. For example, in one aspect, a chemoselective enzyme of the invention can be selective for a single acid, e.g., oleic, linoleic or alpha-linolenic acid individually, or, can be selective for two acids only, e.g., oleic or linoleic acids only, or, linoleic or alpha-linolenic only, etc. Alternatively, an enzyme of the invention can be enantioselective (in esterification or hydrolysis). For example, an enzyme can be selective for only a single position, or, selective for only two positions, e.g., only 1,2 esterification, or, only 1,3 esterification, or, only 2,3 esterification (or, in the reverse reaction, hydrolysis).

In one aspect, the invention provides processes for the selective removal of fatty acids (e.g., undesirable fatty acids) from oils, e.g., separating saturated and/or unsaturated fatty acids from oils, using a hydrolase (e.g., a lipase, an esterase) of the invention. The process of the invention can separate saturated and/or unsaturated fatty acids from any oil, e.g., a soy oil. The enzyme can be chemoselective and/or enantioselective. The process can comprise selective acylation with cis isomers, Sn-2 esterification, enzymatic hydrogenation. In one aspect, these processes generate high stability fats and oils, e.g., "healthy" frying oils. The process of the invention can be used to generate oils with less sulfur, e.g., using a process comprising sulfur removal from crude oil. The enzymes of the invention can also be used in interesterification processes for these and other purposes.

In one aspect, an enzyme of the invention is used to generate a "no-trans" fat oil. In one aspect, a "no-trans" oil is generated from a partially hydrogenated oil to produce a cis-only oil. The enzyme can be chemoselective and/or enantioselective.

In one aspect, the invention provides processes for modifying cocoa butters using an enzyme of the invention. About 80% of cocoa butters comprise POP, SOS and POS triglycerides (P is palmitic fatty acid, O is oleic fatty acid, S is stearic fatty acid). The saturated-unsaturated-saturated fatty acid structure of cocoa butters imparts their characteristic melting profiles, e.g., in chocolates. In one aspect, the structured and direct synthetic processes of the invention are used on cocoa butters to reduce cocoa butter variations or to produce synthetic cocoa butters ("cocoa butter alternatives"). In one aspect, a chemoselective and/or enantioselective (e.g., a regio-selective) hydrolase (e.g., lipase or esterase) of the invention is used to make a cocoa butter alternative, e.g., a cocoa butter substitute, a cocoa butter replacer and/or a cocoa butter equivalent. Thus, the invention also provides cocoa butter alternatives, including cocoa butter substitutes, cocoa butter replacers and cocoa butter equivalents and their manufacturing intermediates comprising an enzyme of the invention. A process of the invention (using an enzyme of the invention) for making cocoa butter alternatives can comprise blending a vegetable oil, e.g., a palm oil, with shea or equivalent, illipe or equivalent and Sal sterins or equivalent. In one aspect, the process of the invention comprises use of interesterification. The process of the invention can generate compositional or crystalline forms that mimic "natural" cocoa butter.

In one aspect, the invention provides processes (using an enzyme of the invention) for producing a diacylglycerol (DAG), e.g., 1,3 diacylglycerol, using a vegetable oil, e.g., a low cost oil. The enzyme can be chemoselective and/or enantioselective. The process of the invention can result in a DAG-comprising composition having good stability, long shelf life and high temperature performance.

Enzymatic Processing of Oilseeds

The invention provides compositions (e.g., hydrolase enzymes of the invention, such as lipases, phospholipases, esterases, proteases) and methods for enzymatic processing of oilseeds, including soybean, canola, coconut, avocado and olive paste. In one aspect, these processes of the invention can increase the oil yield and to improve the nutritional quality of the obtained meals. In some aspects, enzymatic processing of oilseeds using compositions and methods of the invention will provide economical and environmental benefits, as well as alternative technologies for oil extraction and processing food for human and animal consumption. In alternative aspects, the processes of the invention comprise use of any hydrolase of the invention, e.g., a phospholipases of the invention (or another phospholipase), a protease of the invention (or another protease), phosphatases, phytases, xylanases, an amylase, e.g., α-amylases, a glucanase, e.g., β-glucanases, a polygalacturonase, galactolipases, a cellulase, a hemicellulase, a pectinases and/or other plant cell wall degrading enzymes, as well as mixed enzyme preparations and cell lysates, or enzyme preparations from recombinant sources, e.g., host cells or transgenic plants.

In alternative aspects, the processes of the invention can be practiced in conjunction with other processes, e.g., enzymatic treatments, e.g., with carbohydrases, including cellulase, hemicellulase and other side degrading activities, or, chemical processes, e.g., hexane extraction of soybean oil. The enzymatic treatment can increase the oil extractability by 8-10% when the enzymatic treatment is carried out prior to the solvent extraction.

In alternative aspects, the processes of the invention can be practiced with aqueous extraction processes. The aqueous extraction methods can be environmentally cleaner alternative technologies for oil extraction. Low extraction yields of aqueous process can be overcome by using enzymes that hydrolyze the structural polysaccharides forming the cell wall of oilseeds, or that hydrolyze the proteins which form the cell and lipid body membranes, e.g., utilizing digestions comprising cellulase, hemicellulase, and/or protopectinase for extraction of oil from soybean cells. In one aspect, methods are practiced with an enzyme of the invention as described by Kasai (2003) J. Agric. Food Chem. 51:6217-6222, who reported that the most effective enzyme to digest the cell wall was cellulase.

In one aspect, proteases of the invention or other proteases are used in combination with the methods of the invention. The combined effect of operational variables and enzyme activity of a protease and cellulase on oil and protein extraction yields combined with other process parameters, such as enzyme concentration, time of hydrolysis, particle size and solid-to-liquid ratio has been evaluated. In one aspect, methods are practiced with an enzyme of the invention as described by Rosenthal (2001) Enzyme and Microb. Tech. 28:499-509, who reported that use of protease can result in significantly higher yields of oil and protein over the control when heat treated flour is used.

In one aspect, complete protein, pectin, and hemicellulose extraction are used in combination with the methods of the invention. The plant cell consists of a series of polysaccharides often associated with or replaced by proteins or phenolic compounds. Most of these carbohydrates are only partially digested or poorly utilized by the digestive enzymes. The disruption of these structures through processing or degrading enzymes can improve their nutrient availability. In one aspect, methods are practiced with an enzyme of the invention as described by Ouhida (2002) J. Agric. Food Chem. 50:1933-1938, who reported that a significant degradation of the soybean cell wall cellulose (up to 20%) has been achieved after complete protein, pectin, and hemicellulose extraction.

In one aspect, the methods of the invention further comprise incorporation of various enzymatic treatments in the treatment of seeds, e.g., canola seeds, these treatments comprising use of proteases of the invention (or other proteases), cellulases, and hemicellulases (in various combinations with each other and with one or more enzymes of the invention). For example, the methods can comprise enzymatic treatments of canola seeds at 20 to 40 moisture during the incubation with enzymes prior to a conventional process; as described, e.g., by Sosulski (1990) Proc. Can. Inst. Food Sci. Technol. 3:656. The methods of the invention can further comprise incorporation of proteases of the invention (or other proteases), α-amylases, polygalacturonases (in various combinations with each other and with one or more enzymes of the invention) to hydrolyze cellular material in coconut meal and release the coconut oil, which can be recovered by centrifugation, as described, e.g., by McGlone (1986) J. of Food Sci. 51:695-697. The methods of the invention can further comprise incorporation of pectinases, α-amylases, proteases of the invention (or other proteases), cellulases in different combinations (with each other and with one or more enzymes of the invention) to result in significant yield improvement (~70% in the best case) during enzymatic extraction of avocado oil, as described, e.g., by Buenrostro (1986) Biotech. Letters 8(7):505-506. In processes of the invention for olive oil extraction, olive paste is treated with cellulase, hemicellulase, poligalacturonase, pectin-methyltransferase, protease of the invention (or other proteases) and their combinations (with each other and with one or more enzymes of the invention), as described, e.g., by Montedoro (1976) Acta Vitamin. Enzymol. (Milano) 30:13.

Oil Degumming and Vegetable Oil Processing

The enzymes of the invention (e.g., lipases, phospholipases, esterases, proteases of the invention) can be used in various vegetable oil processing steps, such as in vegetable oil extraction, particularly, in the removal of "phospholipid gums" in a process called "oil degumming,".

In one aspect, the invention provides oil degumming processes comprising use of a hydrolase of the invention having a phospholipase C (PLC) activity. In one aspect, the process further comprises addition of a PLA of the invention and/or a patatin-like phospholipase of the invention. In one aspect, all enzymes are added together, or, alternatively, the PLC addition is followed by PLA and/or patatin addition. In one aspect, this process provides a yield improvement as a result of the PLC treatment. In one aspect, this process provides an additional decrease of the phosphorus content of the oil as a result of the PLA treatment.

The invention provides methods for processing vegetable oils from various sources, such as rice bran, soybeans, rapeseed, peanuts and other nuts, sesame, sunflower, palm and corn. The methods can used in conjunction with processes based on extraction with as hexane, with subsequent refining of the crude extracts to edible oils, including use of the methods and enzymes of the invention. The first step in the refining sequence is the so-called "degumming" process, which serves to separate phosphatides by the addition of water. The material precipitated by degumming is separated and further processed to mixtures of lecithins. The commercial lecithins, such as soybean lecithin and sunflower lecithin, are semi-solid or very viscous materials. They consist of a mixture of polar lipids, mainly phospholipids, and oil, mainly triglycerides.

The enzymes (e.g., phospholipases) of the invention can be used in any "degumming" procedure, including water degumming, ALCON oil degumming (e.g., for soybeans), safinco degumming, "super degumming," UF degumming, TOP degumming, uni-degumming, dry degumming and ENZYMAX™ degumming. See, e.g., U.S. Pat. Nos. 6,355,693; 6,162,623; 6,103,505; 6,001,640; 5,558,781; 5,264,367. Various "degumming" procedures incorporated by the methods of the invention are described in Bockisch, M. (1998) In Fats and Oils Handbook, The extraction of Vegetable Oils (Chapter 5), 345-445, AOCS Press, Champaign, Ill. The enzymes (e.g., phospholipases) of the invention can be used in the industrial application of enzymatic degumming of triglyceride oils as described, e.g., in EP 513 709.

In one aspect, hydrolases (e.g., phospholipases) of the invention are used to treat vegetable oils, e.g., crude oils, such as rice bran, soy, canola, flower and the like. In one aspect, this improves the efficiency of the degumming process. In one aspect, the invention provides methods for enzymatic degumming under conditions of low water, e.g., in the range of between about 0.1% to 20% water, or, 0.5% to 10% water. In one aspect, this results in the improved separation of a heavy phase from the oil phase during centrifugation. The improved separation of these phases can result in more efficient removal of phospholipids from the oil, including both hydratable and nonhydratable oils. In one aspect, this can produce a gum fraction that contains less entrained neutral oil, thereby improving the overall yield of oil during the degumming process.

The hydrolases (e.g., phospholipases) of the invention can be used in the industrial application of enzymatic degumming as described, e.g., in CA 1102795, which describes a method of isolating polar lipids from cereal lipids by the addition of at least 50% by weight of water. This method is a modified degumming in the sense that it utilizes the principle of adding water to a crude oil mixture.

In one aspect, the invention provides enzymatic processes comprising use of phospholipases of the invention (e.g., a PLC) comprising hydrolysis of hydrated phospholipids in oil at a temperature of about 20° C. to 40° C., at an alkaline pH, e.g., a pH of about pH 8 to pH 10, using a reaction time of about 3 to 10 minutes. This can result in less than 10 ppm final oil phosphorus levels. The invention also provides enzymatic processes comprising use of phospholipases of the invention (e.g., a PLC) comprising hydrolysis of hydratable and non-hydratable phospholipids in oil at a temperature of about 50° C. to 60° C., at a pH slightly below neutral, e.g., of about pH 5 to pH 6.5, using a reaction time of about 30 to 60 minutes. This can result in less than 10 ppm final oil phosphorus levels.

In one aspect, the invention provides enzymatic processes that utilize a phospholipase C enzyme to hydrolyze a glyceryl phosphoester bond and thereby enable the return of the diacylglyceride portion of phospholipids back to the oil, e.g., a vegetable, fish or algae oil (a "phospholipase C (PLC) caustic refining aid"); and, reduce the phospholipid content in a degumming step to levels low enough for high phosphorous oils to be physically refined (a "phospholipase C (PLC) degumming aid"). The two approaches can generate different values and have different target applications.

In various exemplary processes of the invention, a number of distinct steps compose the degumming process preceding the core bleaching and deodorization refining processes. These steps include heating, mixing, holding, separating and drying. Following the heating step, water and often acid are added and mixed to allow the insoluble phospholipid "gum" to agglomerate into particles which may be separated. While water separates many of the phosphatides in degumming, portions of the phospholipids are non-hydratable phosphatides (NHPs) present as calcium or magnesium salts. Degumming processes address these NHPs by the addition of acid. Following the hydration of phospholipids, the oil is mixed, held and separated by centrifugation. Finally, the oil is dried and stored, shipped or refined. The resulting gums are either processed further for lecithin products or added back into the meal.

In various exemplary processes of the invention phosphorous levels are reduced low enough for physical refining. The separation process can result in potentially higher yield losses than caustic refining. Additionally, degumming processes may generate waste products that may not be sold as commercial lecithin. Therefore, these processes have not achieved a significant share of the market and caustic refining processes continue to dominate the industry for rice bran, soy, canola and sunflower. Note however, that a phospholipase C enzyme employed in a special degumming process would decrease gum formation and return the diglyceride portion of the phospholipid back to the oil.

In one aspect, a phospholipase C enzyme of the invention hydrolyzes a phosphatide at a glyceryl phosphoester bond to generate a diglyceride and water-soluble phosphate compound. The hydrolyzed phosphatide moves to the aqueous phase, leaving the diglyceride in the oil phase. One objective of the PLC "Caustic Refining Aid" is to convert the phospholipid gums formed during neutralization into a diacylglyceride that will migrate back into the oil phase. In contrast, one objective of the "PLC Degumming Aid" is to reduce the phospholipids in crude oil to a phosphorous equivalent of less than 10 parts per million.

In one aspect, a phospholipase C enzyme of the invention will hydrolyze the phosphatide from both hydratable and non-hydratable phospholipids in neutralized crude and degummed oils before bleaching and deodorizing. The target enzyme can be applied as a drop-in product in the existing caustic neutralization process. In this aspect, the enzyme will not be required to withstand extreme pH levels if it is added after the addition of caustic.

In one aspect, a phospholipase of the invention enables phosphorous to be removed to the low levels acceptable in physical refining. In one aspect, a PLC of the invention will hydrolyze the phosphatide from both hydratable and non-hydratable phospholipids in crude oils before bleaching and deodorizing. The target enzyme can be applied as a drop-in product in the existing degumming operation. Given suboptimal mixing in commercial equipment, it is likely that acid will be required to bring the non-hydratable phospholipids in contact with the enzyme at the oil/water interface. Therefore, in one aspect, an acid-stable PLC of the invention is used.

In one aspect, a PLC Degumming Aid process of the invention can eliminate losses in one, or all three, areas: 1) Oil lost in gum formation & separation; 2) Saponified oil in caustic addition; 3) Oil trapped in clay in bleaching. Losses associated in a PLC process can be estimated to be about 0.8% versus 5.2% on a mass basis due to removal of the phosphatide. Additional potential benefits of this process of the invention include the following:

+Reduced adsorbents—less adsorbents required with lower (<5 ppm) phosphorous

Lower chemical usage—less chemical and processing costs associated with hydration of non-hydratable phospholipids Lower waste generation—less water required to remove phosphorous from oil Oils processed (e.g., "degummed") by the methods of the invention include plant oilseeds, e.g., rice bran, soybean oil, rapeseed oil and sunflower oil. In one aspect, the "PLC Caustic Refining Aid" of the invention can save 1.2% over existing caustic refining processes. The refining aid application addresses soy oil that has been degummed for lecithin and these are also excluded from the value/load calculations.

Other processes that can be used with a phospholipase of the invention, e.g., a phospholipase $A_1$ of the invention can convert non-hydratable native phospholipids to a hydratable form. In one aspect, the enzyme is sensitive to heat. This may be desirable, since heating the oil can destroy the enzyme. However, the degumming reaction must be adjusted to pH 4-5 and 60° C. to accommodate this enzyme. At 300 Units/kg oil saturation dosage, this exemplary process is successful at taking previously water-degummed oil phosphorous content down to ≦10 ppm P. Advantages can be decreased $H_2O$ content and resultant savings in usage, handling and waste.

In addition to these various "degumming" processes, the enzymes of the invention can be used in any vegetable oil processing step. For example, phospholipase enzymes of the invention can be used in place of PLA, e.g., phospholipase A2, in any vegetable oil processing step. Oils that are "processed" or "degummed" in the methods of the invention include soybean oils, rapeseed oils, corn oils, oil from rice bran oils, palm kernels, canola oils, sunflower oils, sesame oils, peanut oils, and the like. The main products from this process include triglycerides.

In one exemplary process, when the enzyme is added to and reacted with a crude oil, the amount of phospholipase employed is about 10-10,000 units, or, alternatively, about, 100-2,000 units, per 1 kg of crude oil. The enzyme treatment is conducted for 5 min to 10 hours at a temperature of 30° C. to 90° C., or, alternatively, about, 40° C. to 70° C. The conditions may vary depending on the optimum temperature of the enzyme. The amount of water added to dissolve the enzyme is 5-1,000 wt. parts per 100 wt. parts of crude oil, or, alternatively, about, 10 to 200 wt. parts per 100 wt. parts of crude oil.

Upon completion of such enzyme treatment, the enzyme liquid is separated with an appropriate means such as a centrifugal separator and the processed oil is obtained. Phosphorus-containing compounds produced by enzyme decomposition of gummy substances in such a process are practically all transferred into the aqueous phase and removed from the oil phase. Upon completion of the enzyme treatment, if necessary, the processed oil can be additionally washed with water or organic or inorganic acid such as, e.g., acetic acid, phosphoric acid, succinic acid, and the like, or with salt solutions.

In one exemplary process for ultra-filtration degumming, the enzyme is bound to a filter or the enzyme is added to an oil prior to filtration or the enzyme is used to periodically clean filters.

In one aspect, the invention provides processes using a hydrolase of the invention, e.g., a phospholipase of the invention, such as a phospholipase-specific phosphohydrolase of the invention, or another phospholipase, in a modified "organic refining process," which can comprise addition of the enzyme (e.g., a hydrolase, such as a PLC) in a citric acid holding tank.

Enzymes of the invention are used to improve oil extraction and oil degumming (e.g., vegetable oils). In one aspect, a hydrolase (e.g., phospholipase, such as a PLC) of the invention and at least one plant cell wall degrader (e.g., a cellulase, a hemicellulase or the like, to soften walls and increase yield at extraction) is used in a process of the invention. In this exemplary approach to using enzymes of the invention to improve oil extraction and oil degumming, a hydrolase (e.g., phospholipase C) of the invention as well as other hydrolases (e.g., a cellulase, a hemicellulase, an esterase of the invention or another esterase, a protease of the invention or another protease and/or a phosphatase) are used during the crushing steps associated with oil production (including but not limited to soybean, canola, rice bran and sunflower oil). By using enzymes prior to or in place of solvent extraction, it is possible to increase oil yield and reduce the amount of hydratable and non-hydratable phospholipids in the crude oil. The reduction in non-hydratable phospholipids may result from conversion of potentially non-hydratable phospholipids to diacylglycerol and corresponding phosphate-ester prior to complexation with calcium or magnesium. The overall reduction of phospholipids in the crude oil will result in improved yields during refining with the potential for eliminating the requirement for a separate degumming step prior to bleaching and deodorization.

In one exemplary process for a phospholipase-mediated physical refining aid, water and enzyme are added to crude oil. In one aspect, a PLC or a PLD and a phosphatase are used in the process. In phospholipase-mediated physical refining, the water level can be low, i.e. 0.5-5% and the process time should be short (less than 2 hours, or, less than 60 minutes, or, less than 30 minutes or, less than 15 minutes, or, less than 5 minutes). The process can be run at different temperatures (25° C. to 70° C.), using different acids and/or caustics, at different pHs (e.g., 3-10).

In alternate aspects, water degumming is performed first to collect lecithin by centrifugation and then PLC or PLC and PLA is added to remove non-hydratable phospholipids (the process should be performed under low water concentration). In another aspect, water degumming of crude oil to less than 10 ppm (edible oils) and subsequent physical refining (less than 50 ppm for biodiesel) is performed. In one aspect, an emulsifier is added and/or the crude oil is subjected to an intense mixer to promote mixing. Alternatively, an emulsion-breaker is added and/or the crude oil is heated to promote separation of the aqueous phase. In another aspect, an acid is added to promote hydration of non-hydratable phospholipids. Additionally, phospholipases can be used to mediate purification of phytosterols from the gum/soapstock.

The enzymes of the invention can be used in any oil processing method, e.g., degumming or equivalent processes. For example, the enzymes of the invention can be used in processes as described in U.S. Pat. Nos. 5,558,781; 5,264,367; 6,001,640. The process described in U.S. Pat. No. 5,558,781 uses either phospholipase A1, A2 or B, essentially breaking down lecithin in the oil that behaves as an emulsifier.

The enzymes and methods of the invention can be used in processes for the reduction of phosphorus-containing components in edible oils comprising a high amount of non-hydratable phosphorus by using of a phospholipase of the invention, e.g., a polypeptide having a phospholipase A and/or B activity, as described, e.g., in EP Patent Number: EP 0869167. In one aspect, the edible oil is a crude oil, a so-called "non-degummed oil." In one aspect, the method treat a non-degummed oil, including pressed oils or extracted oils, or a mixture thereof, from, e.g., rice bran, rapeseed, soybean, sesame, peanut, corn or sunflower. The phosphatide content in a crude oil can vary from 0.5 to 3% w/w corresponding to a phosphorus content in the range of 200 to 1200 ppm, or, in the range of 250 to 1200 ppm. Apart from the phosphatides, the crude oil can also contains small concentrations of carbohydrates, sugar compounds and metal/phosphatide acid complexes of Ca, Mg and Fe. In one aspect, the process comprises treatment of a phospholipid or lysophospholipid with the phospholipase of the invention so as to hydrolyze fatty acyl groups. In one aspect, the phospholipid or lysophospholipid comprises lecithin or lysolecithin. In one aspect of the process the edible oil has a phosphorus content from between about 50 to 250 ppm, and the process comprises treating the oil with a phospholipase of the invention so as to hydrolyze a major part of the phospholipid and separating an aqueous phase containing the hydrolyzed phospholipid from the oil. In one aspect, prior to the enzymatic degumming process the oil is water-degummed. In one aspect, the methods provide for the production of an animal feed comprising mixing the phospholipase of the invention with feed substances and at least one phospholipid.

The enzymes and methods of the invention can be used in processes of oil degumming as described, e.g., in WO 98/18912. The phospholipases of the invention can be used to reduce the content of phospholipid in an edible oil. The process can comprise treating the oil with a phospholipase of the invention to hydrolyze a major part of the phospholipid and separating an aqueous phase containing the hydrolyzed phospholipid from the oil. This process is applicable to the purification of any edible oil, which contains a phospholipid, e.g. vegetable oils, such as rice bran, soybean oil, rapeseed oil and sunflower oil, fish oils, algae and animal oils and the like. Prior to the enzymatic treatment, the vegetable oil is preferably pretreated to remove slime (mucilage), e.g. by wet refining. The oil can contain 50-250 ppm of phosphorus as phospholipid at the start of the treatment with phospholipase, and the process of the invention can reduce this value to below 5-10 ppm.

The enzymes of the invention can be used in processes as described in JP Application No.: H5-132283, filed Apr. 25, 1993, which comprises a process for the purification of oils and fats comprising a step of converting phospholipids present in the oils and fats into water-soluble substances containing phosphoric acid groups and removing them as water-soluble substances. An enzyme action is used for the conversion into water-soluble substances. An enzyme having a phospholipase C activity is preferably used as the enzyme.

The enzymes of the invention can be used in processes as described as the "Organic Refining Process," (ORP) (IPH, Omaha, Nebr.) which is a method of refining seed oils. ORP may have advantages over traditional chemical refining, including improved refined oil yield, value added co-products, reduced capital costs and lower environmental costs.

The enzymes of the invention can be used in processes for the treatment of an oil or fat, animal or vegetal, raw, semi-processed or refined, comprising adding to such oil or fat at least one enzyme of the invention that allows hydrolyzing and/or depolymerizing the non-glyceridic compounds contained in the oil, as described, e.g., in EP Application number: 82870032.8. Exemplary methods of the invention for hydrolysis and/or depolymerization of non-glyceridic compounds in oils are:

1) The addition and mixture in oils and fats of an enzyme of the invention or enzyme complexes previously dissolved in a small quantity of appropriate solvent (for example water). A certain number of solvents are possible, but a non-toxic and suitable solvent for the enzyme is chosen. This addition may be done in processes with successive loads, as well as in continuous processes. The quantity of enzyme(s) necessary to be added to oils and fats, according to this process, may range, depending on the enzymes and the products to be processed, from 20 to 400 ppm, i.e., from 0.02 kg to 0.4 kg of enzyme for 1000 kg of oil or fat, and preferably from 20 to 100 ppm, i.e., from 0.02 to 0.1 kg of enzyme for 1000 kg of oil, these values being understood to be for concentrated enzymes, i.e., without diluent or solvent.
2) Passage of the oil or fat through a fixed or insoluble filtering bed of enzyme(s) of the invention on solid or semi-solid supports, preferably presenting a porous or fibrous structure. In this technique, the enzymes are trapped in the micro-cavities of the porous or fibrous structure of the supports. These consist, for example, of resins or synthetic polymers, cellulose carbonates, gels such as agarose, filaments of polymers or copolymers with porous structure, trapping small droplets of enzyme in solution in their cavities. Concerning the enzyme concentration, it is possible to go up to the saturation of the supports.
3) Dispersion of the oils and fats in the form of fine droplets, in a diluted enzymatic solution, preferably containing 0.2 to 4% in volume of an enzyme of the invention. This technique is described, e.g., in Belgian patent No. 595,219. A cylindrical column with a height of several meters, with conical lid, is filled with a diluted enzymatic solution. For this purpose, a solvent that is non-toxic and non-miscible in the oil or fat to be processed, preferably water, is chosen. The bottom of the column is equipped with a distribution system in which the oil or fat is continuously injected in an extremely divided form (approximately 10,000 flux per $m^2$). Thus an infinite number of droplets of oil or fat are formed, which slowly rise in the solution of enzymes and meet at the surface, to be evacuated continuously at the top of the conical lid of the reactor.

Palm oil can be pre-treated before treatment with an enzyme of the invention. For example, about 30 kg of raw palm oil is heated to +50° C. 1% solutions were prepared in distilled water with cellulases and pectinases. 600 g of each of these was added to aqueous solutions of the oil under strong agitation for a few minutes. The oil is then kept at +50° C. under moderate agitation, for a total reaction time of two hours. Then, temperature is raised to +90° C. to deactivate the enzymes and prepare the mixture for filtration and further processing. The oil is dried under vacuum and filtered with a filtering aid.

The enzymes of the invention can be used in processes as described in EP patent EP 0 513 709 B2. For example, the invention provides a process for the reduction of the content process for the reduction of the content of phosphorus-containing components in animal and vegetable oils by enzymatic decomposition using a phospholipase of the invention. A predemucilaginated animal and vegetable oil with a phosphorus content of 50 to 250 ppm is agitated with an organic carboxylic acid and the pH value of the resulting mixture set to pH 4 to pH 6, an enzyme solution which contains phospholipase $A_1$, $A_2$, or B of the invention is added to the mixture in a mixing vessel under turbulent stirring and with the formation of fine droplets, where an emulsion with 0.5 to 5% by weight relative to the oil is formed, said emulsion being conducted through at least one subsequent reaction vessel under turbulent motion during a reaction time of 0.1 to 10 hours at temperatures in the range of 20 to 80° C. and where the treated oil, after separation of the aqueous solution, has a phosphorus content under 5 ppm.

The organic refining process is applicable to both crude and degummed oil. The process uses inline addition of an organic acid under controlled process conditions, in conjunction with conventional centrifugal separation. The water separated naturally from the vegetable oil phospholipids ("VOP") is recycled and reused. The total water usage can be substantially reduced as a result of the Organic Refining Process.

The phospholipases and methods of the invention can also be used in the enzymatic treatment of edible oils, as described, e.g., in U.S. Pat. No. 6,162,623. In this exemplary methods, the invention provides an amphiphilic enzyme. It can be immobilized, e.g., by preparing an emulsion containing a continuous hydrophobic phase and a dispersed aqueous phase containing the enzyme and a carrier for the enzyme and removing water from the dispersed phase until this phase turns into solid enzyme coated particles. The enzyme can be a lipase. The immobilized lipase can be used for reactions catalyzed by lipase such as interesterification of mono-, di-or triglycerides, de-acidification of a triglyceride oil, or removal of phospholipids from a triglyceride oil when the lipase is a phospholipase. The aqueous phase may contain a fermentation liquid, an edible triglyceride oil may be the hydrophobic phase, and carriers include sugars, starch, dextran, water soluble cellulose derivatives and fermentation residues. This exemplary method can be used to process triglycerides, diglycerides, monoglycerides, glycerol, phospholipids or fatty acids, which may be in the hydrophobic phase. In one aspect, the process for the removal of phospholipids from triglyceride oil comprising mixing a triglyceride oil containing phospholipids with a preparation containing a phospholipase of the invention; hydrolyzing the phospholipids to lysophospholipid; separating the hydrolyzed phospholipids from the oil, wherein the phospholipase is an immobilized phospholipase.

The enzymes (e.g., lipases, phospholipases, esterases, proteases) of the invention and methods of the invention can also be used in the enzymatic treatment of edible oils, as described, e.g., in U.S. Pat. No. 6,127,137. One exemplary method hydrolyzes both fatty acyl groups in intact phospholipid. A phospholipase of the invention used in this method can have no lipase activity and can be active at very low pH. These properties make it very suitable for use in oil degumming, as enzymatic and alkaline hydrolysis (saponification) of the oil can both be suppressed.

In one aspect, the invention provides a process for hydrolyzing fatty acyl groups in a phospholipid or lysophospholipid comprising treating the phospholipid or lysophospholipid with the phospholipase that hydrolyzes both fatty acyl groups in a phospholipid and is essentially free of lipase activity. In one aspect, the phospholipase of the invention has a temperature optimum at about 50° C., measured at pH 3 to pH 4 for 10 minutes, and a pH optimum of about pH 3, measured at 40° C. for about 10 minutes. In one aspect, the phospholipid or lysophospholipid comprises lecithin or lysolecithin. In one aspect, after hydrolyzing a major part of the phospholipid, an aqueous phase containing the hydrolyzed phospholipid is separated from the oil. In one aspect, the invention provides a process for removing phospholipid from an edible oil, comprising treating the oil at pH 1.5 to 3 with a dispersion of an aqueous solution of the phospholipase of the invention, and separating an aqueous phase containing the hydrolyzed phospholipid from the oil. In one aspect, the oil is treated to remove mucilage prior to the treatment with the phospholipase. In one aspect, the oil prior to the treatment with the phospholipase contains the phospholipid in an amount corresponding to 50 to 250 ppm of phosphorus. In one aspect, the treatment with phospholipase is done at 30° C. to 45° C. for 1 to 12 hours at a phospholipase dosage of 0.1 to 10 mg/l in the presence of 0.5 to 5% of water.

The enzymes (e.g., lipases, phospholipases, esterases, proteases) of the invention and methods of the invention can also be used in the enzymatic treatment of edible oils, as described, e.g., in U.S. Pat. No. 6,025,171. In this exemplary method, enzymes of the invention are immobilized by preparing an emulsion containing a continuous hydrophobic phase, such as a triglyceride oil, and a dispersed aqueous phase containing an amphiphilic enzyme, such as lipase or a phospholipase of the invention, and carrier material that is partly dissolved and partly undissolved in the aqueous phase, and removing water from the aqueous phase until the phase turns into solid enzyme coated carrier particles. The undissolved part of the carrier material may be a material that is insoluble in water and oil, or a water soluble material in undissolved form because the aqueous phase is already saturated with the water soluble material. The aqueous phase may be formed with a crude lipase fermentation liquid containing fermentation residues and biomass that can serve as carrier materials. Immobilized lipase is useful for ester re-arrangement and de-acidification in oils. After a reaction, the immobilized enzyme can be regenerated for a subsequent reaction by adding water to obtain partial dissolution of the carrier, and with the resultant enzyme and carrier-containing aqueous phase dispersed in a hydrophobic phase evaporating water to again form enzyme coated carrier particles.

The enzymes (e.g., lipases, phospholipases, esterases, proteases) of the invention and methods of the invention can also be used in the enzymatic treatment of edible oils, as described, e.g., in U.S. Pat. No. 6,143,545. This exemplary method is used for reducing the content of phosphorous containing components in an edible oil comprising a high amount of non-hydratable phosphorus content using a phospholipase of the invention. In one aspect, the method is used to reduce the content of phosphorus containing components in an edible oil having a non-hydratable phosphorus content of at least 50 ppm measured by pre-treating the edible oil, at 60° C., by addition of a solution comprising citric acid monohydrate in water (added water vs. oil equals 4.8% w/w; (citric acid) in water phase=106 mM, in water/oil emulsion=4.6 mM) for 30 minutes; transferring 10 ml of the pre-treated water in oil emulsion to a tube; heating the emulsion in a boiling water bath for 30 minutes; centrifuging at 5000 rpm for 10 minutes, transferring about 8 ml of the upper (oil) phase to a new tube and leaving it to settle for 24 hours; and drawing 2 g from the upper clear phase for measurement of the non-hydratable phosphorus content (ppm) in the edible oil. The method also can comprise contacting an oil at a pH from about pH 5 to 8 with an aqueous solution of a phospholipase A or B of the invention (e.g., PLA1, PLA2, or a PLB), which solution is emulsified in the oil until the phosphorus content of the oil is reduced to less than 11 ppm, and then separating the aqueous phase from the treated oil.

The enzymes (e.g., lipases, phospholipases, esterases, proteases) of the invention and methods of the invention can also be used in the enzymatic treatment of edible oils, as described, e.g., in U.S. Pat. No. 5,532,163. The invention provides processes for the refining of oil and fat by which phospholipids in the oil and fat to be treated can be decomposed and removed efficiently. In one aspect, the invention provides a process for the refining of oil and fat which comprises reacting, in an emulsion, the oil and fat with an enzyme of the invention, e.g., an enzyme having an activity to decompose glycerol-fatty acid ester bonds in glycerophospholipids (e.g., a PLA2 of the invention); and another process in which the enzyme-treated oil and fat is washed with water or an acidic aqueous solution. In one aspect, the acidic aqueous solution to be used in the washing step is a solution of at least one acid, e.g., citric acid, acetic acid, phosphoric acid and salts thereof. In one aspect, the emulsified condition is formed using 30 weight parts or more of water per 100 weight parts of the oil and fat. Since oil and fat can be purified without employing the conventional alkali refining step, generation of washing waste water and industrial waste can be reduced. In addition, the recovery yield of oil is improved because loss of neutral oil and fat due to their inclusion in these wastes does not occur in the inventive process. In one aspect, the invention provides a process for refining oil and fat containing about 100 to 10,000 ppm of phospholipids which comprises: reacting, in an emulsified condition, said oil and fat with an enzyme of the invention having activity to decompose glycerol-fatty acid ester bonds in glycerophospholipids. In one aspect, the invention provides processes for refining oil and fat containing about 100 to 10,000 ppm of phospholipids which comprises reacting, in an emulsified condition, oil and fat with an enzyme of the invention having activity to decompose glycerol-fatty acid ester bonds in glycerophospholipids; and subsequently washing the treated oil and fat with a washing water.

The enzymes (e.g., lipases, phospholipases, esterases, proteases) of the invention and methods of the invention can also be used in the enzymatic treatment of edible oils, as described, e.g., in U.S. Pat. No. 5,264,367. The content of phosphorus-containing components and the iron content of an edible vegetable or animal oil, such as an oil, e.g., soybean oil, which has been wet-refined to remove mucilage, are reduced by enzymatic decomposition by contacting the oil with an aqueous solution of an enzyme of the invention, e.g., a phospholipase A1, A2, or B, and then separating the aqueous phase from the treated oil. In one aspect, the invention provides an enzymatic method for decreasing the content of phosphorus-and iron-containing components in oils, which have been refined to remove mucilage. An oil, which has been refined to remove mucilage, can be treated with an enzyme of the invention, e.g., phospholipase C, A1, A2, or B. Phosphorus contents below 5 ppm and iron contents below 1 ppm can be achieved. The low iron content can be advantageous for the stability of the oil.

The enzymes (e.g., lipases, phospholipases, esterases, proteases) of the invention and methods of the invention can also be used for preparing transesterified oils, as described, e.g., in U.S. Pat. No. 5,288,619. The invention provides methods for enzymatic transesterification for preparing a margarine oil having both low trans-acid and low intermediate chain fatty acid content. The method includes the steps of providing a transesterification reaction mixture containing a stearic acid source material and an edible liquid vegetable oil, transesterifying the stearic acid source material and the vegetable oil using a 1-, 3-positionally specific lipase, and then finally hydrogenating the fatty acid mixture to provide a recycle stearic acid source material for a recyclic reaction with the vegetable oil. The invention also provides a counter-current method for preparing a transesterified oil. The method includes the steps of providing a transesterification reaction zone containing a 1-, 3-positionally specific lipase, introducing a vegetable oil into the transesterification zone, introducing a stearic acid source material, conducting a supercritical gas or subcritical liquefied gas counter-current fluid, carrying out a transesterification reaction of the triglyceride stream with the stearic acid or stearic acid monoester stream in the reaction zone, withdrawing a transesterified triglyceride margarine oil stream, withdrawing a counter-current fluid phase, hydrogenating the transesterified stearic acid or stearic acid monoester to provide a hydrogenated recycle stearic acid source material, and introducing the hydrogenated recycle stearic acid source material into the reaction zone.

In one aspect, the highly unsaturated phospholipid compound may be converted into a triglyceride by appropriate use of a phospholipase C of the invention to remove the phosphate group in the sn-3 position, followed by 1,3 lipase acyl ester synthesis. The 2-substituted phospholipid may be used as a functional food ingredient directly, or may be subsequently selectively hydrolyzed in reactor 160 using an immobilized phospholipase C of the invention to produce a 1-diglyceride, followed by enzymatic esterification as described herein to produce a triglyceride product having a 2-substituted polyunsaturated fatty acid component.

The enzymes (e.g., lipases, phospholipases, esterases, proteases) of the invention and methods of the invention can also be used in a vegetable oil enzymatic degumming process as described, e.g., in U.S. Pat. No. 6,001,640. This method of the invention comprises a degumming step in the production of edible oils. Vegetable oils from which hydratable phosphatides have been eliminated by a previous aqueous degumming process are freed from non-hydratable phosphatides by enzymatic treatment using a phospholipase of the invention. The process can be gentle, economical and environment-friendly. Phospholipases that only hydrolyze lysolecithin, but not lecithin, are used in this degumming process.

In one aspect, to allow the enzyme of the invention to act, both phases, the oil phase and the aqueous phase that contain the enzyme, must be intimately mixed. It may not be sufficient to merely stir them. Good dispersion of the enzyme in the oil is aided if it is dissolved in a small amount of water, e.g., 0.5-5 weight-% (relative to the oil), and emulsified in the oil in this form, to form droplets of less than 10 micrometers in diameter (weight average). The droplets can be smaller than 1 micrometer. Turbulent stirring can be done with radial velocities above 100 cm/sec. The oil also can be circulated in the reactor using an external rotary pump. The aqueous phase containing the enzyme can also be finely dispersed by means of ultrasound action. A dispersion apparatus can be used.

The enzymatic reaction probably takes place at the border surface between the oil phase and the aqueous phase. It is the goal of all these measures for mixing to create the greatest possible surface for the aqueous phase which contains the enzyme. The addition of surfactants increases the microdispersion of the aqueous phase. In some cases, therefore, surfactants with HLB values above 9, such as Na-dodecyl sulfate, are added to the enzyme solution, as described, e.g., in EP-A 0 513 709. A similar effective method for improving emulsification is the addition of lysolecithin. The amounts added can lie in the range of 0.001% to 1%, with reference to the oil. The temperature during enzyme treatment is not critical. Temperatures between 20° C. and 80° C. can be used, but the latter can only be applied for a short time. In this aspect, a phospholipase of the invention having a good temperature and/or low pH tolerance is used. Application temperatures of between 30° C. and 50° C. are optimal. The treatment period depends on the temperature and can be kept shorter with an increasing temperature. Times of 0.1 to 10 hours, or, 1 to 5 hours are generally sufficient. The reaction takes place in a degumming reactor, which can be divided into stages, as described, e.g., in DE-A 43 39 556. Therefore continuous operation is possible, along with batch operation. The reaction can be carried out in different temperature stages. For example, incubation can take place for 3 hours at 40° C., then for 1 hour at 60° C. If the reaction proceeds in stages, this also opens up the possibility of adjusting different pH values in the individual stages. For example, in the first stage the pH of the solution can be adjusted to 7, for example, and in a second stage to 2.5, by adding citric acid. In at least one stage, however, the pH of the enzyme solution must be below 4, or, below 3. If the pH was subsequently adjusted below this level, a deterioration of effect may be found. Therefore the citric acid can be added to the enzyme solution before the latter is mixed into the oil.

After completion of the enzyme treatment, the enzyme solution, together with the decomposition products of the NHP contained in it, can be separated from the oil phase, in batches or continuously, e.g., by means of centrifugation. Since the enzymes are characterized by a high level of stability and the amount of the decomposition products contained in the solution is slight (they may precipitate as sludge) the same aqueous enzyme phase can be used several times. There is also the possibility of freeing the enzyme of the sludge, see, e.g., DE-A 43 39 556, so that an enzyme solution which is essentially free of sludge can be used again. In one aspect of this degumming process, oils which contain less than 15 ppm phosphorus are obtained. One goal is phosphorus contents of less than 10 ppm; or, less than 5 ppm. With phosphorus contents below 10 ppm, further processing of the oil according to the process of distillative de-acidification is easily possible. A number of other ions, such as magnesium, calcium, zinc, as well as iron, can be removed from the oil, e.g., below 0.1 ppm. Thus, this product possesses ideal prerequisites for good oxidation resistance during further processing and storage.

The enzymes (e.g., lipases, phospholipases, esterases, proteases) of the invention and methods of the invention also can also be used for reducing the amount of phosphorous-containing components in vegetable and animal oils as described, e.g., in EP patent EP 0513709. In this method, the content of phosphorus-containing components, especially phosphatides, such as lecithin, and the iron content in vegetable and animal oils, which have previously been deslimed, e.g. soya oil, are reduced by enzymatic breakdown using a phospholipase A1, A2 or B of the invention.

The enzymes (e.g., lipases, phospholipases, esterases, proteases) of the invention and methods of the invention can also be used for reducing fat or oils as described, e.g., in JP 06306386. The invention provides processes for refining a fat or oil comprising a step of converting a phospholipid in a fat or an oil into a water-soluble phosphoric-group-containing substance and removing this substance. The action of an enzyme of the invention (e.g., a PLC) is utilized to convert the phospholipid into the substance. Thus, it is possible to refine a fat or oil without carrying out an alkali refining step from which industrial wastes containing alkaline waste water and a large amount of oil are produced. Improvement of yields can be accomplished because the loss of neutral fat or oil from escape with the wastes can be reduced to zero. In one aspect, gummy substances are converted into water-soluble substances and removed as water-soluble substances by adding an enzyme of the invention having a phospholipase C activity in the stage of degumming the crude oil and conducting enzymatic treatment. In one aspect, the phospholipase C of the invention has an activity that cuts ester bonds of glycerin and phosphoric acid in phospholipids. If necessary, the method can comprise washing the enzyme-treated oil with water or an acidic aqueous solution. In one aspect, the enzyme of the invention is added to and reacted with the crude oil. The amount of phospholipase C employed can be 10 to 10,000 units, or, about 100 to 2,000 units, per 1 kg of crude oil.

The enzymes (e.g., lipases, phospholipases, esterases, proteases) of the invention and methods of the invention can also be used for water-degumming processes as described, e.g., in Dijkstra, Albert J., et al., Oleagineux, Corps Gras, Lipides (1998), 5(5), 367-370. In this exemplary method, the water-degumming process is used for the production of lecithin and for dry degumming processes using a degumming acid and bleaching earth. This method may be economically feasible only for oils with a low phosphatide content, e.g., palm oil, lauric oils, etc. For seed oils having a high NHP-content, the acid refining process is used, whereby this process is carried out at the oil mill to allow gum disposal via the meal. In one aspect, this acid refined oil is a possible "polishing" operation to be carried out prior to physical refining.

The enzymes (e.g., lipases, phospholipases, esterases, proteases) of the invention and methods of the invention can also be used for degumming processes as described, e.g., in Dijkstra, et al., Res. Dev. Dep., N.V. Vandemoortele Coord. Cent., Izegem, Belg. JAOCS, J. Am. Oil Chem. Soc. (1989), 66:1002-1009. In this exemplary method, the total degumming process involves dispersing an acid such as $H_3PO_4$ or citric acid into soybean oil, allowing a contact time, and then mixing a base such as caustic soda or Na silicate into the acid-in-oil emulsion. This keeps the degree of neutralization low enough to avoid forming soaps, because that would lead to increased oil loss. Subsequently, the oil passed to a centrifugal separator where most of the gums are removed from the oil stream to yield a gum phase with minimal oil content. The oil stream is then passed to a second centrifugal separator to remove all remaining gums to yield a dilute gum phase, which is recycled. Washing and drying or in-line alkali refining complete the process. After the adoption of the total degumming process, in comparison with the classical alkali refining process, an overall yield improvement of about 0.5% is realized. The totally degummed oil can be subsequently alkali refined, bleached and deodorized, or bleached and physically refined.

The enzymes (e.g., lipases, phospholipases, esterases, proteases) of the invention and methods of the invention can also be used for the removal of nonhydratable phospholipids from a plant oil, e.g., soybean oil, as described, e.g., in Hvolby, et al., Sojakagefabr., Copenhagen, Den., J. Amer. Oil Chem. Soc. (1971) 48:503-509. In this exemplary method, water-degummed oil is mixed at different fixed pH values with buffer solutions with and without $Ca^{++}$, Mg/Ca-binding reagents, and surfactants. The nonhydratable phospholipids can be removed in a nonconverted state as a component of micelles or of mixed emulsifiers. Furthermore, the nonhydratable phospholipids are removable by conversion into dissociated forms, e.g., by removal of Mg and Ca from the phosphatidates, which can be accomplished by acidulation or by treatment with Mg/Ca-complexing or Mg/Ca-precipitating reagents. Removal or chemical conversion of the nonhydratable phospholipids can result in reduced emulsion formation and in improved separation of the deacidified oil from the emulsion layer and the soapstock.

The enzymes (e.g., lipases, phospholipases, esterases, proteases) of the invention and methods of the invention can also be used for the degumming of vegetable oils as described, e.g., Buchold, et al., Frankfurt/Main, Germany. Fett Wissenschaft Technologie (1993), 95(8), 300-304. In this exemplary process of the invention for the degumming of edible vegetable oils, aqueous suspensions of an enzyme of the invention, e.g., phospholipase A2, is used to hydrolyze the fatty acid bound at the sn2 position of the phospholipid, resulting in 1-acyl-lysophospholipids which are insoluble in oil and thus more amenable to physical separation. Even the addition of small amounts corresponding to about 700 lecitase units/kg oil results in a residual P concentration of less than 10 ppm, so that chemical refining is replaceable by physical refining, eliminating the necessity for neutralization, soapstock splitting, and wastewater treatment.

The enzymes (e.g., lipases, phospholipases, esterases, proteases) of the invention and methods of the invention can also be used for the degumming of vegetable oils as described, e.g., by EnzyMax, Dahlke, Klaus. Dept. G-PDO, Lurgi Ol-Gas, Chemie, GmbH, Frankfurt, Germany; Oleagineux, Corps Gras, Lipides (1997), 4(1), 55-57. This exemplary process is a degumming process for the physical refining of almost any kind of oil. By an enzymatic-catalyzed hydrolysis, phosphatides are converted to water-soluble lysophosphatides which are separated from the oil by centrifugation. The residual phosphorus content in the enzymatically degummed oil can be as low as 2 ppm P.

The enzymes (e.g., lipases, phospholipases, esterases, proteases) of the invention and methods of the invention can also be used for the degumming of vegetable oils as described, e.g., by Cleenewerck, et al., N. V. Vamo Mills, Izegem, Belg. Fett Wissenschaft Technologie (1992), 94:317-22; and, Clausen, Kim; Nielsen, M., Novozymes A/S, Den. Dansk Kemi (2002) 83(2):24-27. The phospholipases and methods of the invention can incorporate the pre-refining of vegetable oils with acids as described, e.g., by Nilsson-Johansson, et al., Fats Oils Div., Alfa-Laval Food Eng. AB, Tumba, Swed. Fett Wissenschaft Technologie (1988), 90(11), 447-51; and, Munch, Ernst W. Cereol Deutschland GmbH, Mannheim, Germany. Editor(s): Wilson, Richard F., Proceedings of the World Conference on Oilseed Processing Utilization, Cancun, Mexico, Nov. 12-17, 2000 (2001), Meeting Date 2000, 17-20.

The enzymes (e.g., lipases, phospholipases, esterases, proteases) of the invention and methods of the invention can also be used for the degumming of vegetable oils as described, e.g., by Jerzewska, et al., Inst. Przemyslu Miesnego i Tluszczowego, Warsaw, Pol., Tluszcze Jadalne (2001), 36(3/4), 97-110. In this process of the invention, enzymatic degumming of hydrated low-erucic acid rapeseed oil is by use of a phospholipase A2 of the invention. The enzyme can catalyze the hydrolysis of fatty acid ester linkages to the central carbon atom of the glycerol moiety in phospholipids. It can hydrolyze non-hydratable phospholipids to their corresponding hydratable lyso-compounds. With a nonpurified enzyme preparation, better results can be achieved with the addition of 2% preparation for 4 hours (87% P removal).

In another exemplary process of the invention for oil degumming (or an oil degumming process using an enzyme of the invention), an acidic polymer, e.g., an alginate or pectin, is added. In this oil degumming process of the invention, an acidic polymer (e.g. alginic acid or pectin or a more soluble salt form) is added to the crude oil with a low amount of water (e.g., in a range of between about 0.5 to 5%). In this aspect, the acidic polymers can reduce and/or disrupt phospholipid-metal complexes by binding calcium and/or magnesium in the crude oil, thereby improving the solubility of nonhydratable phospholipids. In one aspect, these phospholipids will enter the aqueous phase and either be converted to diacylglycerol and the corresponding side chain or the intact phospholipid will be removed by subsequent centrifugation as a component of the heavy phase. The presence of the acidic polymer in the aqueous phase can also increase the density of the aqueous phase and result in an improved separation of the heavy phase from the oil (light) phase.

One exemplary process of the invention for oil degumming (or an oil degumming process using an enzyme of the invention) alters the deodorization procedure to get a diacylglycerol (DAG) fraction. In alternative aspect, if necessary or desired, following enzyme-assisted degumming, the deodorization conditions (temperature, pressure, configuration of the distillation apparatus) can be modified with the goal of improving the separation of the free fatty acids (FFA) from the diacylglycerol/triacylglycerol fraction or further modified to separate the diacylglycerol from the triacylglycerol fraction. As a result of these modifications, using this method of the invention, it is possible to obtain food grade FFA and diacylglycerol if a hydrolase of the invention (e.g., a phosphatase, or, a PLC or a combination of PLC and phosphatases) are used to degum edible oil in a physical refining process.

In various aspects, practicing the methods of the invention as described herein (or using the enzymes of the invention), have advantages such as: decrease or eliminate solvent and solvent recovery; lower capital costs; decrease downstream refining costs, decrease chemical usage, equipment, process time, energy (heat) and water usage/wastewater generation; produce higher quality oil; expeller pressed oil may be used without refining in some cooking and sautéing applications (this pressed oil may have superior stability, color and odor characteristics and high tocopherol content); produce higher quality meal; produce a lower fat content in meal (currently, meal coming out of mechanical press causes digestion problems in ruminants); produce improved nutritional attributes—reduced levels of glucosinolates, tannins, sinapine, phytic acid (as described, e.g., in Technology and Solvents for Extracting Oilseeds and Nonpetroleum Oils, AOCS 1997).

In one aspect, the invention provides methods for refining vegetable oils (e.g., soybean oil, corn oil, cottonseed oil, palm oil, peanut oil, rapeseed oil, safflower oil, sunflower seed oil, sesame seed oil, rice bran oil, coconut oil or canola oil) and their byproducts, and processes for deodorizing lecithin, for example, as described in U.S. Pat. No. 6,172,248, or 6,172,247, wherein the methods comprise use of at least one hydrolase of the invention, e.g., a phospholipase, such as a phospholipase C of the invention. Thus, the invention provides lecithin and vegetable oils comprising at least one enzyme of the invention. In an exemplary organic acid refining process, vegetable oil is combined with a dilute aqueous organic acid solution and subjected to high shear to finely disperse the acid solution in the oil. The resulting acid-and-oil mixture is mixed at low shear for a time sufficient to sequester contaminants into a hydrated impurities phase, producing a purified vegetable oil phase. In this exemplary process, a mixer or recycle system (e.g., recycle water tank) and/or a phosphatide or lecithin storage tank can be used, e.g., as described in U.S. Pat. Nos. 4,240,972, 4,049,686, 6,172,247 or 6,172,248. These processes can be conducted as a batch or continuous process. Crude or degummed vegetable oil can be supplied from a storage tank (e.g., through a pump) and can be heated. The vegetable oil to be purified can be either crude or "degummed" oil.

In one aspect, hydrolase enzymes such as the phosphatidylinositol-PLC (PI-PLC) enzymes of the invention are used for vegetable oil degumming. Hydrolase enzymes of the invention having PI-PLC activity can be used alone or in combination with other enzymes (for instance PLC, PLD, phosphatase enzymes of the invention) to improve oil yield during the degumming of vegetable oils (including soybean, canola, and sunflower). The PI-PLC enzymes of the invention may preferentially convert phosphatidylinositol to 1,2-diacylglycerol (DAG) and phosphoinositol but it may also demonstrate activity on other phospholipids including phosphatidylcholine, phosphatidylethanolamine, phosphatidylserine, or phosphatidic acid. The improvement in yield will be realized as an increase in the amount of DAG in the enzyme-treated vegetable oil and an increase in neutral oil, due to a decrease in the amount of oil entrained in the smaller gum fraction that results from enzyme treatment of the vegetable oil.

Purification of Phytosterols from Vegetable Oils

The invention provides methods for purification of phytosterols and triterpenes, or plant sterols, from vegetable oils using the enzymes of the invention. Phytosterols that can be purified using enzymes (e.g., phospholipases) and methods of the invention include β-sitosterol, campesterol, stigmasterol, stigmastanol, β-sitostanol, sitostanol, desmosterol, chalinasterol, poriferasterol, clionasterol and brassicasterol. Plant sterols are important agricultural products for health and nutritional industries. Thus, enzymes and methods of the invention are used to make emulsifiers for cosmetic manufacturers and steroidal intermediates and precursors for the production of hormone pharmaceuticals. Enzymes and methods of the invention are used to make (e.g., purify) analogs of phytosterols and their esters for use as cholesterol-lowering agents with cardiologic health benefits. Enzymes and methods of the invention are used to purify plant sterols to reduce serum cholesterol levels by inhibiting cholesterol absorption in the intestinal lumen. Enzymes and methods of the invention are used to purify plant sterols that have immunomodulating properties at extremely low concentrations, including enhanced cellular response of T lymphocytes and cytotoxic ability of natural killer cells against a cancer cell line. Enzymes and methods of the invention are used to purify plant sterols for the treatment of pulmonary tuberculosis, rheumatoid arthritis, management of HIV-infested patients and inhibition of immune stress, e.g., in marathon runners.

Enzymes and methods of the invention are used to purify sterol components present in the sterol fractions of commodity vegetable oils (e.g., coconut, canola, cocoa butter, corn, cottonseed, linseed, olive, palm, peanut, rice bran, safflower, sesame, soybean, sunflower oils), such as sitosterol (40.2-92.3%), campesterol (2.6-38.6%), stigmasterol (0-31%) and 5-avenasterol (1.5-29%).

Methods of the invention can incorporate isolation of plant-derived sterols in oil seeds by solvent extraction with chloroform-methanol, hexane, methylene chloride, or acetone, followed by saponification and chromatographic purification for obtaining enriched total sterols. Alternatively, the plant samples can be extracted by supercritical fluid extraction with supercritical carbon dioxide to obtain total lipid extracts from which sterols can be enriched and isolated. For subsequent characterization and quantification of sterol compounds, the crude isolate can be purified and separated by a wide variety of chromatographic techniques including column chromatography (CC), gas chromatography, thin-layer chromatography (TLC), normal phase high-performance liquid chromatography (HPLC), reversed-phase HPLC and capillary electrochromatography. Of all chromatographic isolation and separation techniques, CC and TLC procedures employ the most accessible, affordable and suitable for sample clean up, purification, qualitative assays and preliminary estimates of the sterols in test samples.

Phytosterols are lost in the vegetable oils lost as byproducts during edible oil refining processes. Phospholipases and methods of the invention use phytosterols isolated from such byproducts to make phytosterol-enriched products isolated from such byproducts. Phytosterol isolation and purification methods of the invention can incorporate oil processing industry byproducts and can comprise operations such as molecular distillation, liquid-liquid extraction and crystallization.

Methods of the invention can incorporate processes for the extraction of lipids to extract phytosterols. For example, methods of the invention can use nonpolar solvents as hexane (commonly used to extract most types of vegetable oils) quantitatively to extract free phytosterols and phytosteryl fatty-acid esters. Steryl glycosides and fatty-acylated steryl glycosides are only partially extracted with hexane, and increasing polarity of the solvent gave higher percentage of extraction. One procedure that can be used is the Bligh and Dyer chloroform-methanol method for extraction of all sterol lipid classes, including phospholipids. One exemplary method to both qualitatively separate and quantitatively analyze phytosterol lipid classes comprises injection of the lipid extract into HPLC system.

Enzymes and methods of the invention can be used to remove sterols from fats and oils, as described, e.g., in U.S. Pat. No. 6,303,803. This is a method for reducing sterol content of sterol-containing fats and oils. It is an efficient and cost effective process based on the affinity of cholesterol and other sterols for amphipathic molecules that form hydrophobic, fluid bilayers, such as phospholipid bilayers. Aggregates of phospholipids are contacted with, for example, a sterol-containing fat or oil in an aqueous environment and then mixed. The molecular structure of this aggregated phospholipid mixture has a high affinity for cholesterol and other sterols, and can selectively remove such molecules from fats and oils. The aqueous separation mixture is mixed for a time sufficient to selectively reduce the sterol content of the fat/oil product through partitioning of the sterol into the portion of phospholipid aggregates. The sterol-reduced fat or oil is separated from the aqueous separation mixture. Alternatively, the correspondingly sterol-enriched fraction also may be isolated from the aqueous separation mixture. These steps can be performed at ambient temperatures, costs involved in heating are minimized, as is the possibility of thermal degradation of the product. Additionally, a minimal amount of equipment is required, and since all required materials are food grade, the methods require no special precautions regarding handling, waste disposal, or contamination of the final product(s).

Enzymes and methods of the invention can be used to remove sterols from fats and oils, as described, e.g., in U.S. Pat. No. 5,880,300. Phospholipid aggregates are contacted with, for example, a sterol-containing fat or oil in an aqueous environment and then mixed. Following adequate mixing, the sterol-reduced fat or oil is separated from the aqueous separation mixture. Alternatively, the correspondingly sterol-enriched phospholipid also may be isolated from the aqueous separation mixture. Plant (e.g., vegetable) oils contain plant sterols (phytosterols) that also may be removed using the methods of the present invention. This method is applicable to a fat/oil product at any stage of a commercial processing cycle. For example, the process of the invention may be applied to refined, bleached and deodorized oils ("RBD oils"), or to any stage of processing prior to attainment of RBD status. Although RBD oil may have an altered density compared to pre-RBD oil, the processes of the are readily adapted to either RBD or pre-RBD oils, or to various other fat/oil products, by variation of phospholipid content, phospholipid composition, phospholipid:water ratios, temperature, pressure, mixing conditions, and separation conditions as described below.

Alternatively, the enzymes and methods of the invention can be used to isolate phytosterols or other sterols at intermediate steps in oil processing. For example, it is known that phytosterols are lost during deodorization of plant oils. A sterol-containing distillate fraction from, for example, an intermediate stage of processing can be subjected to the sterol-extraction procedures described above. This provides a sterol-enriched lecithin or other phospholipid material that can be further processed in order to recover the extracted sterols.

Nutraceuticals

In one aspect, the compositions and methods of the invention can be used to make nutraceuticals by processing or synthesizing lipids and oils using the enzymes of the invention, e.g., esterases, acylases, lipases, phospholipases or proteases of the invention. In one aspect, the processed or synthesized lipids or oils include poly-unsaturated fatty acids (PUFAs), diacylglycerides, e.g., 1,3-diacyl glycerides (DAGs), monoacylglycerides, e.g., 2-monoacylglycerides (MAGs) and triacylglycerides (TAGs). In one aspect, the nutraceuticals is made by processing diacylglycerides, e.g., 1,3-diacyl glycerides (DAGs), monoacylglycerides, e.g., 2-monoacylglycerides (MAGs) and/or triacylglycerides (TAGs) from plant (e.g., oilseed) sources or from animal (e.g., fish oil) sources.

In one aspect, the compositions and methods of the invention can be used to fortify dietary compositions, especially cow's milk based products, e.g., cow's milk-based infant formulas, with bile salt-activated hydrolases. The compositions made by the methods and compositions of the invention can be used to feed newborn and premature infants, including administration of a bile salt-activated hydrolase of the invention to increase fat digestion and therefore growth rate. Similarly, the invention provides compositions and methods for treating subjects for inadequate pancreatic enzyme production by administration of bile salt-activated hydrolase in conjunction with ingestion of fats; see also discussion, below.

In one aspect, the invention provides a dietary composition comprising a hydrolase of the invention, e.g., bile salt-activated hydrolase of the invention. In one aspect, the invention provides a dietary composition comprising a nutritional base comprising a fat and an effective amount of bile salt-activated hydrolase of the invention. In one aspect, the invention provides a cow's milk-based infant formula comprising a hydrolase of the invention, e.g., bile salt-activated hydrolase of the invention. In one aspect, the hydrolase of the invention is active in the digestion of long chain fatty acids, e.g., $C_{12}$ to $C_{22}$, which make up a very high percentage of most milks, e.g., 99% of human breast milk. See, e.g., U.S. Pat. No. 5,000,975.

In one aspect, the invention provides a dietary composition comprising a vegetable oil fat and a hydrolase of the invention. The invention provides methods of processing milk based products and/or vegetable oil-comprising compositions to make dietary compositions. In one aspect, the processed compositions comprise a lauric acid oil, an oleic acid oil, a palmitic acid oil and/or a linoleic acid oil. In one aspect, a rice bran oil, sunflower oleic oil and/or canola oil may be used as oleic acids oils. In one aspect, fats and oils, e.g., oilseeds, from plants, including, e.g., rice, canola, sunflower, olive, palm, soy or lauric type oils for use in the nutraceuticals and dietary compositions are processed or made using a hydrolase of the invention. See, e.g., U.S. Pat. No. 4,944,944.

In one aspect, the enzymes of the invention are provided in a form that is stable to storage in the formula and/or the stomach, but active when the formulation reaches the portion of the gastrointestinal tract where the formula would normally be digested. Formulations (e.g., microcapsules) for release in the intestine are well known in the art, e.g., biodegradable polymers such as polylactide and polyglycolide, as described, e.g., in U.S. Pat. Nos. 4,767,628; 4,897,268; 4,925,673; 5,902,617.

Confectionaries, Cacao Butter and Foods

In one aspect, the compositions and methods of the invention can be used to make and process hard butters, such as cacao butter (cocao butter). The compositions and methods of the invention can be used to make cocoa butter alternatives by "structured" synthetic techniques using the enzymes of the invention, e.g., esterases, acylases, lipases, phospholipases or proteases of the invention. For example, in one aspect, the methods of the invention process or synthesize triacylglycerides, diacylglycerides and/or monoacylglycerides for use as, e.g., cocoa butter alternatives. In one aspect, the methods of the invention generate a hard butter with a defined "plastic region" to maintain sufficient hardness below or at room temperature. In one aspect, the processed or synthesized lipid is designed to have a very narrow "plastic region," e.g., in one aspect, where it rapidly melts at about body temperature. Natural cacao butter begins to soften at approximately 30° C. to 32° C., and completely melts at approximately 36° C. Natural cacao butter can contain 70 wt % or more of three 1,3-disaturated-2-oleoyl glycerols, which are 1,3-dipalmitoyl-2-oleoyl glycerol (POP), 1-palmitoyl-2-oleoyl glycerol (POSt) and 1,3-distearoyl-2-oleoyl glycerol (StOSt). These three glycerols show a similar melting behavior to each other and are responsible for melting properties of the cacao butter, exhibiting a very narrow plastic region. The invention provides synthetic cacao butters or processed cacao butters (synthesized or processed using a hydrolase of the invention, all possible composition are referred to as cocoa-butter alternatives) with varying percentages of ,3-dipalmitoyl-2-oleoyl glycerol (POP), 1-palmitoyl-2-oleoyl glycerol (POSt) and 1,3-distearoyl-2-oleoyl glycerol (StOSt), depending on the desired properties of the synthetic cacao butter, and, synthetic cacao butters with more or less than 70 wt % of the three 1,3-disaturated-2-oleoyl glycerols. The synthetic cacao butters of the invention can partially or completely replace natural or unprocessed cacao butters and can maintain or improve essential hard butter properties.

The invention provides synthetic cacao butters or processed cacao butters (synthesized or processed using a hydrolase of the invention) with desired properties for use in confectionary, bakery and pharmaceutical products. In one aspect, the invention provides confectionary, bakery and pharmaceutical products comprising a hydrolase of the invention. In one aspect, the methods of the invention make or process a lipid (a fat) from a confection (e.g., a chocolate) or to be used in a confection. In one aspect, a lipid is made or processed such that the chocolate shows less finger-imprinting than chocolate made from natural cocoa butter, while still having sharp melting characteristics in the mouth. In one aspect, a lipid is made or processed such that a confection (e.g., chocolate) can be made at a comparatively high ambient temperature, or, be made using a cooling water at a comparatively high temperature. In one aspect, the lipid is made or processed such that a confection (e.g., chocolate) can be stored under relatively warmer conditions, e.g., tropical or semi-tropical conditions or in centrally heated buildings. In one aspect, the lipids are made or processed such that a confection (e.g., chocolate) will have a lipid (fat) content of consistent composition and quality. The enzymes of the invention can be used to provide a substitute composition for cacao butter which can significantly improve its thermal stability and replace it in a wide range of applications.

Margarine and Shortening Production

The invention provides synthetic or processed fats, e.g., margarine and shortening synthesized or processed using a hydrolase of the invention. In one aspect, the invention provides processed fats comprising a vegetable oil, such as soybean oil, corn oil, rapeseed oil, palm oil or lauric type oils synthesized or processed using a hydrolase of the invention. The synthetic or processed fats, e.g., margarine and shortening, are designed to have a desired "plasticity." Many of the plastic fat products, such as margarine and shortening, are produced from hard stocks and liquid oils as raw materials. For example, liquid oils such as soybean oil, corn oil, palm oil and rapeseed oil, are blended with their hardened oils (hard stocks), and the blend is adjusted to have an appropriate consistency (plasticity). The plastic fat products such as margarine and shortening so produced tend to cause the formation of relatively coarse crystallines because fats and oils used as the raw materials are composed of fatty acids having almost the same carbon chain length. In other words, they have a highly-unified composition of fatty acids. For this reason, the plasticity of these products can be maintained at an appropriate degree only within a narrow temperature range, so that the liquid oils contained therein have a tendency to exude. In one aspect, the invention provides methods of making or processing fats designed such that they have a varied (and defined) composition of fatty acids. The resultant oil, e.g., margarine or shortening, can have a broader range of plasticity.

In one aspect, the methods and compositions of the invention are used to make or process vegetable oils, such as soybean oil, corn oil, rapeseed oil, palm oil or lauric type oils using the hydrolases of the invention, including inter-esterification and enzymatic transesterification, see e.g., U.S. Pat. No. 5,288,619. The methods and compositions of the invention can be used in place of random inter-esterification as described in, e.g., U.S. Pat. No. 3,949,105. In one aspect, the methods and compositions of the invention are used to in enzymatic transesterification for preparing an oil, e.g., a margarine oil, having both low trans-acid and low intermediate chain fatty acid content.

In one aspect, the symmetric structure of an oil, e.g., a palm or lauric type oils is modified, e.g., into a random structure.

Thus, the methods of the invention can be used to modify the properties of plastic fat products. In one aspect, the modification of oils by the methods of the invention can be designed to prevent or slow gradually hardening of the oil with time, particularly when the products are being stored.

In one aspect, the methods and compositions of the invention in a trans-esterification reaction mixture comprising a stearic acid source material and an edible liquid vegetable oil, trans-esterifying the stearic acid source material and the vegetable oil using a 1-, 3-positionally specific lipase of the invention, and then hydrogenating the fatty acid mixture to provide a recycle stearic acid source material for a recyclic reaction with the vegetable oil. See e.g., U.S. Pat. No. 5,288,619.

In one aspect, an inter-esterification reaction is conducted with a lipase of the invention. In one aspect, the lipase of the invention has a selectivity for the 1-and 3-positions of triglyceride to slow or inhibit an increase in the amount of tri-saturated triglycerides in the oil. In this reaction of the invention, deficiencies of conventional random inter-esterification and the difficulty of inter-esterification with a non-specific lipase can be overcome because the inter-esterification is conducted by an enzyme of the invention having a specificity for the 1-and 3-positions of triglycerides. In one aspect, the exudation of liquid oils contained in the products is slowed or prevented with a temperature increase in the reaction to inhibit a rise in the melting point caused by an increase in the amount of tri-saturated triglycerides. This addresses the problem of hardening of products during long-term storage.

Latex Processing

The methods and compositions (e.g., enzymes of the invention, e.g., esterases, acylases, lipases, phospholipases or proteases of the invention) of the invention can be used to selectively hydrolyze saturated esters over unsaturated esters into acids or alcohols. In one aspect, the invention provides for the selective hydrolysis of ethyl propionate over ethyl acrylate. In one aspect, these methods are used to remove undesired esters from monomer feeds used in latex polymerization and from the latexes after polymerization. The methods and compositions (hydrolases) of the invention can be used to treat latexes for a variety of purposes, e.g., to treat latexes used in hair fixative compositions to remove unpleasant odors. Latexes treated by the methods and compositions of the invention include, e.g., polymers containing acrylic, vinyl and unsaturated acid monomers, including alkyl acrylate monomers such as methyl acrylate, ethyl acrylate, propyl acrylate and butyl acrylate, and acrylate acids such as acrylic acid, methacrylic acid, crotonic acid, itaconic acid and mixtures thereof. See, e.g., U.S. Pat. No. 5,856,150.

Treating Hydrolase Deficiencies

The methods and compositions (enzymes of the invention, e.g., esterases, acylases, lipases, phospholipases or proteases of the invention) of the invention can be used in the treatment of a hydrolase deficiency in an animal, e.g., a mammal, such as a human. For example, in one aspect, the methods and compositions of the invention are used to treat patients suffering from a deficiency of a pancreatic lipase. In one aspect, the lipase is administered orally. An enzyme of the invention can be delivered in place of or with a preparation of pig pancreas enzyme.

In one aspect, the compositions of the invention used for these treatments are active under acidic conditions. In one aspect, the compositions of the invention are administered orally in formulations (e.g., tablets) that pass through the acid regions of the stomach and discharge the enzyme only in the relatively alkaline environment of the jejunum. In one aspect, a hydrolase of the invention is formulated with a carrier such as lactose, saccharose, sorbitol, mannitol, starch, cellulose derivatives or gelatine or any other such excipient. A lubricant such as magnesium stearate, calcium stearate or polyethylene glycol wax also can be added. A concentrated sugar solution, which may contain additives such as talc, titanium dioxide, gelatine or gum Arabic, can be added as a coating. Soft or hard capsules can be used to encapsulate a hydrolase as a liquid or as a solid preparation. See, e.g., U.S. Pat. Nos. 5,691,181; 5,858,755.

Detergents

The methods and compositions (enzymes of the invention, e.g., esterases, acylases, lipases, phospholipases or proteases of the invention) of the invention can be used in making and using detergents. A hydrolase of the invention can be added to, e.g., be blended with, any known detergent composition, solid or liquid, with or without changing the composition of the detergent composition. For examples, a hydrolase of the invention can be added to any soap, e.g., aliphatic sulfates such as straight or branched chain alkyl or alkenyl sulfates, amide sulfates, alkyl or alkenyl ether sulfates having a straight or branched chain alkyl or alkenyl group to which one or more of ethylene oxide, propylene oxide and butylene oxide added, aliphatic sulfonates such as alkyl sulfonates, amide sulfonates, dialkyl sulfosuccinates, sulfonates of alpha-olefins, of vinylidene-type olefins and of internal olefins, aromatic sulfonates such as straight or branched chain alkylbenzenesulfonates, alkyl or alkenyl ether carbonates or amides having a straight or branched chain alkyl or alkenyl group to which one or more of ethylene oxide, propylene oxide and butylene oxide added, or amides, alpha-sulfo-fatty acid salts or esters, amino acid type surfactants, phosphate surfactants such as alkyl or alkenyl acidic phosphates, and alkyl or alkenyl phosphates, sulfonic acid type amphoteric surfactants, betaine type amphoteric surfactants, alkyl or alkenyl ethers or alcohols having a straight or branched chain alkyl or alkenyl group to which one or more of ethylene oxide, propylene oxide and butylene oxide added, polyoxy-ethylenealkyl phenyl ethers having a straight or branched chain alkyl group to which one or more of ethylene oxide, propylene oxide and butylene oxide added, higher fatty acid alkanolamides or alkylene oxide adducts thereof, sucrose fatty acid esters, fatty acid glycerol monoesters, alkyl-or alkenyl-amine oxides, tetraalkyl-ammonium salt type cationic surfactants, or a combination thereof. See, e.g., U.S. Pat. No. 5,827,718.

The invention provides detergent compositions comprising one or more polypeptides (hydrolases) of the invention. Surface-active and/or non-surface-active forms can be used. In one aspect, the amount of total hydrolase, surface-active and/or non-surface-active, used in the invention can be from about 0.0001% to about 1.0%, or from about 0.0002% to about 0.5%, by weight, of the detergent composition. In one aspect, of the detergent composition, the surface-active hydrolase is from about 5% to about 67% and the non-surface-active hydrolase is from about 33% to about 95% of the total hydrolase activity in the enzymatic mixture. In one aspect, the optimum pH of the total enzymatic mixture is between about 5 to about 10.5.

In one aspect, the detergent compositions of the invention include alkaline hydrolases of the invention which function at alkaline pH values, since the pH of a washing solution can be in an alkaline pH range under ordinary washing conditions. See, e.g., U.S. Pat. No. 5,454,971

The polypeptides of the invention (enzymes of the invention, e.g., esterases, acylases, lipases, phospholipases or proteases of the invention) can be used in any detergent composition, which are well known in the art, see, e.g., U.S. Pat.

Nos. 5,069,810; 6,322,595; 6,313,081. For example, in one aspect, a laundry detergent composition is provided. It can comprise 0.8 ppm to 80 ppm of a lipase of the invention.

The invention incorporates all methods of making and using detergent compositions, see, e.g., U.S. Pat. Nos. 6,413,928; 6,399,561; 6,365,561; 6,380,147.

The invention incorporates all methods of making and using detergent compositions, see, e.g., U.S. Pat. Nos. 6,413,928; 6,399,561; 6,365,561; 6,380,147. The detergent compositions can be a one and two part aqueous composition, a non-aqueous liquid composition, a cast solid, a granular form, a particulate form, a compressed tablet, a gel and/or a paste and a slurry form. The hydrolases of the invention can also be used as a detergent additive product in a solid or a liquid form. Such additive products are intended to supplement or boost the performance of conventional detergent compositions and can be added at any stage of the cleaning process.

The invention also provides methods capable of removing gross food soils, films of food residue and other minor food compositions using these detergent compositions. Hydrolases of the invention can facilitate the removal of stains by means of catalytic hydrolysis of proteins. Hydrolases of the invention can be used in dishwashing detergents in textile laundering detergents.

The actual active enzyme content depends upon the method of manufacture of a detergent composition and is not critical, assuming the detergent solution has the desired enzymatic activity. In one aspect, the amount of hydrolases present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the hydrolases of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Enzymes of the invention can be formulated into powdered and liquid detergents having pH between 4.0 and 12.0 at levels of about 0.01 to about 5% (preferably 0.1% to 0.5%) by weight. These detergent compositions can also include other enzymes such as proteases, cellulases, lipases or endoglycosidases, endo-beta.-1,4-glucanases, beta-glucanases, endo-beta-1,3(4)-glucanases, cutinases, peroxidases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases. These detergent compositions can also include builders and stabilizers.

The addition of hydrolases of the invention to conventional cleaning compositions does not create any special use limitation. In other words, any temperature and pH suitable for the detergent is also suitable for the compositions of the invention as long as the enzyme is active at or tolerant of the pH and/or temperature of the intended use. In addition, the proteases of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. A hydrolase of the invention may be included as a detergent additive. The detergent composition of the invention may, for example, be formulated as a hand or machine laundry detergent composition comprising a polypeptide of the invention. A laundry additive suitable for pre-treatment of stained fabrics can comprise a polypeptide of the invention. A fabric softener composition can comprise a hydrolase of the invention. Alternatively, a hydrolases of the invention can be formulated as a detergent composition for use in general household hard surface cleaning operations. In alternative aspects, detergent additives and detergent compositions of the invention may comprise one or more other enzymes such as a protease, a lipase, a cutinase, another protease, a carbohydrase, a cellulase, a pectinase, a mannanase, an arabinase, a galactanase, a xylanase, an oxidase, e.g., a lactase, and/or a peroxidase (see also, above). The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

When formulated as compositions suitable for use in a laundry machine washing method, the hydrolases of the invention can comprise both a surfactant and a builder compound. They can additionally comprise one or more detergent components, e.g., organic polymeric compounds, bleaching agents, additional enzymes, suds suppressors, dispersants, lime-soap dispersants, soil suspension and anti-redeposition agents and corrosion inhibitors. Laundry compositions of the invention can also contain softening agents, as additional detergent components. Compositions containing hydrolases of the invention can provide fabric cleaning, stain removal, whiteness maintenance, softening, color appearance, dye transfer inhibition and sanitization when formulated as laundry detergent compositions.

The density of the laundry detergent compositions of the invention can range from about 200 to 1500 g/liter, or, about 400 to 1200 g/liter, or, about 500 to 950 g/liter, or, 600 to 800 g/liter, of composition; this can be measured at about 20° C.

The "compact" form of laundry detergent compositions of the invention is best reflected by density and, in terms of composition, by the amount of inorganic filler salt. Inorganic filler salts are conventional ingredients of detergent compositions in powder form. In conventional detergent compositions, the filler salts are present in substantial amounts, typically 17% to 35% by weight of the total composition. In one aspect of the compact compositions, the filler salt is present in amounts not exceeding 15% of the total composition, or, not exceeding 10%, or, not exceeding 5% by weight of the composition. The inorganic filler salts can be selected from the alkali and alkaline-earth-metal salts of sulphates and chlorides, e.g., sodium sulphate.

Liquid detergent compositions of the invention can also be in a "concentrated form." In one aspect, the liquid detergent compositions can contain a lower amount of water, compared to conventional liquid detergents. In alternative aspects, the water content of the concentrated liquid detergent is less than 40%, or, less than 30%, or, less than 20% by weight of the detergent composition. Detergent compounds of the invention can comprise formulations as described in WO 97/01629.

Hydrolases of the invention can be useful in formulating various cleaning compositions. A number of known compounds are suitable surfactants including nonionic, anionic, cationic, or zwitterionic detergents, can be used, e.g., as disclosed in U.S. Pat. Nos. 4,404,128; 4,261,868; 5,204,015. In addition, enzymes of the invention can be used, for example, in bar or liquid soap applications, dish care formulations, contact lens cleaning solutions or products, peptide hydrolysis, waste treatment, textile applications, as fusion-cleavage enzymes in protein production, and the like. Hydrolases of the invention may provide enhanced performance in a detergent composition as compared to another detergent protease, that is, the enzyme group may increase cleaning of certain enzyme sensitive stains such as grass or blood, as determined by usual evaluation after a standard wash cycle. Hydrolases of the invention can be formulated into known powdered and liquid detergents having pH between 6.5 and 12.0 at levels of about 0.01 to about 5% (for example, about 0.1% to 0.5%) by weight. These detergent cleaning compositions can also include other enzymes such as other known esterases, phospholipases, proteases, amylases, cellulases, lipases or endoglycosidases, as well as builders and stabilizers.

Processes for Coating and Finishing Fabrics

The methods and compositions (enzymes of the invention, e.g., esterases, acylases, lipases, phospholipases or proteases of the invention) of the invention can be used in processes for coating and finishing fabrics, fibers or yarns. In one aspect, insoluble cellulosic polymers are reacted with carboxylic acids or esters thereof in the presence of a hydrolase of the invention. The cellulosic polymer may be cotton, viscose, rayon, lyocell, flax, linen, ramie, and all blends thereof; and blends thereof with polyesters, wool, polyamides, acrylics and polyacrylics. In alternative aspects, the methods and compositions (hydrolases) of the invention can be used in a softening finish process, i.e. improvement of the hand and drape of the final fabric, for dyeing a polymeric material, for obtaining flame retardancy, for obtaining water repellency, for obtaining brightness, e.g. optical brightness, of a polymeric material, and for obtaining resin finishing ("permanent press"). In one aspect, the methods and compositions (hydrolases) of the invention can be used for obtaining flame retardancy in a fabric using, e.g., a halogen-substituted carboxylic acid or an ester thereof, i.e. a fluorinated, chlorinated or bromated carboxylic acid or an ester thereof. In one aspect, the processes are carried out under conditions (e.g. temperature, pH, solvent) that favors the esterification process over hydrolytic cleavage of an ester bend. In one aspect, the esterification process is carried out using water as a solvent, or, the process may be carried out without a solvent, or, the reaction may take place in a microemulsion formed by adding an carboxylic acid or an ester thereof to a mixture of water and a suitable surfactant. See, e.g., U.S. Pat. No. 5,733,750.

In one aspect, a hydrolase of the invention is absorbed or adsorbed or otherwise immobilized on a surface, such as a fabric, fiber or yarn. In one aspect, a fabric-hydrolase complex is formed for, e.g., lipid removal, e.g., food or oil stain removal. The hydrolase may be sorbed on the fabric, fiber or yarn before or after staining. The active hydrolase can hydrolyze the stain on dry fabric, fiber or yarn, or fabric, fiber or yarn in laundering solutions. In one aspect, a hydrolase of the invention has enhanced stability to denaturation by surfactants and to heat deactivation. In the way, the hydrolase can be resistant to removal from the fabric, fiber or yarn during laundering, can retain substantial activity after drying at an elevated temperature, and can retain activity during fabric storage or wear. Redeposition of food, oil and oil hydrolysis by-products during laundering of fabric also can be retarded by a hydrolase of the invention. Oil hydrolysis by-products can be removed during laundering of the fabric, e.g., at a basic pH or in the presence of a surfactant. In one aspect, a hydrolase of the invention is absorbed or adsorbed or otherwise immobilized on a gel, glass, plastic or metal solid as well as a fabric, fiber or yarn.

In alternative aspects, hydrolases of the invention are useful to treat a wide variety of natural, synthetic or metallic fabrics, including textiles or woven or non-woven cloths, including nylon, polycotton, polyester, woven polyester, double knit polyester, silk, vinyl, cotton flannel, rayon velvet, acrylic felt, wool blend (polyester/wool), synthetic blend (polyester/polyurethane), latexes. Other surfaces that can be treated with a hydrolase of the invention include kitchen or cooking devices and utensils, e.g., pot cleaner materials such as cellulose sponge, nylon and stainless steel scrubbers and copper cloth, dishwashers, food storage devices, e.g., refrigerators, freezers and the like.

The surfaces that have been treated in accordance with the invention can already be stained by (or carrying) oil before an enzyme-fabric complex is formed or the complex can be formed before such exposure. Examples of embodiments useful for the former applications include pre-wash liquid or gelled compositions that can be sprayed or directly applied to specific areas of oily stains. The garments or linens can then be stored in a laundry hamper, for example, and laundered in the normal course of a household's routine because degradation of the oily stain into hydrolysis by-products will be occurring during storage. Alternatively, fabric may be pre-treated before use to convey improved oil stain removal properties. In one aspect, a hydrolase is immobilized on surfaces to facilitate oil removal from the surfaces and to alter wettability of the surfaces. In one aspect, a hydrolase is adsorbed on a fabric before or after an oil stain, and the hydrolase is active to hydrolyze an oil stain on dry fabric or fabric in laundering solutions. In one aspect, the sorbed hydrolase has enhanced stability to denaturation by surfactants and to heat deactivation, is resistant to removal from fabric during laundering, retains substantial activity after drying fabric at an elevated temperature, and/or retains activity during fabric storage or wear. In one aspect, redeposition of oil and oil hydrolysis by-products during laundering of fabric is retarded by the hydrolase. In one aspect, oil hydrolysis by-products are removable during laundering of fabric at a basic pH or in the presence of a surfactant. See, e.g., U.S. Pat. No. 6,265,191.

Treating Fibers and Textiles

The invention provides methods of treating fibers and fabrics using one or more hydrolases of the invention. The hydrolases can be used in any fiber-or fabric-treating method, which are well known in the art, see, e.g., U.S. Pat. Nos. 6,261,828; 6,077,316; 6,024,766; 6,021,536; 6,017,751; 5,980,581; US Patent Publication No. 20020142438 A1. For example, hydrolases of the invention can be used in fiber and/or fabric desizing. In one aspect, the feel and appearance of a fabric is improved by a method comprising contacting the fabric with a hydrolase of the invention in a solution. In one aspect, the fabric is treated with the solution under pressure. For example, hydrolases of the invention can be used in the removal of stains.

In one aspect, hydrolases of the invention are applied during or after the weaving of textiles, or during the desizing stage, or one or more additional fabric processing steps. During the weaving of textiles, the threads are exposed to considerable mechanical strain. Prior to weaving on mechanical looms, warp yarns are often coated with sizing starch or starch derivatives in order to increase their tensile strength and to prevent breaking. The hydrolases of the invention can be applied to remove these sizing starch or starch derivatives. After the textiles have been woven, a fabric can proceed to a desizing stage. This can be followed by one or more additional fabric processing steps. Desizing is the act of removing "size" from textiles. After weaving, the size coating must be removed before further processing the fabric in order to ensure a homogeneous and wash-proof result. The invention provides a method of desizing comprising enzymatic treatment of the "size" by the action of hydrolases of the invention.

The enzymes of the invention can be used to desize fabrics, including cotton-containing fabrics, as detergent additives, e.g., in aqueous compositions. The invention provides methods for producing a stonewashed look on indigo-dyed denim fabric and garments. For the manufacture of clothes, the fabric can be cut and sewn into clothes or garments. These can be finished before or after the treatment. In particular, for the manufacture of denim jeans, different enzymatic finishing methods have been developed. The finishing of denim garment normally is initiated with an enzymatic desizing step, during which garments are subjected to the action of amylolytic enzymes in order to provide softness to the fabric and make the cotton more accessible to the subsequent enzymatic finishing steps. The invention provides methods of finishing denim garments (e.g., a "bio-stoning process"), enzymatic desizing and providing softness to fabrics using the hydrolases of the invention. The invention provides methods for quickly softening denim garments in a desizing and/or finishing process.

Other enzymes can be also be used in these desizing processes. For example, an alkaline and thermostable amylase and hydrolase can be combined in a single bath for desizing and bioscouring. Among advantages of combining desizing and scouring in one step are cost reduction and lower environmental impact due to savings in energy and water usage and lower waste production. Exemplary application conditions for desizing and bioscouring are about pH 8.5 to 10.0 and temperatures of about 40° C. and up. Using a hydrolase of the invention, low enzyme dosages, e.g., about 100 grams (g) per a ton of cotton, and short reaction times, e.g., about 15 minutes, can be used to obtain efficient desizing and scouring with out added calcium.

In one aspect, an alkaline and thermostable amylase and hydrolase are combined in a single bath desizing and bioscouring. Among advantages of combining desizing and scouring in one step are cost reduction and lower environmental impact due to savings in energy and water usage and lower waste production. Application conditions for desizing and bioscouring can be between about pH 8.5 to pH 10.0 and temperatures at about 40° C. and up. Low enzyme dosages (e.g., about 100 g per a ton of cotton) and short reaction times (e.g., about 15 minutes) can be used to obtain efficient desizing and scouring with out added calcium.

The hydrolases of the invention can be used in combination with other carbohydrate degrading enzymes, e.g., cellulase, arabinanase, xyloglucanase, pectinase, and the like, for the preparation of fibers or for cleaning of fibers. These can be used in combination with detergents. In one aspect, hydrolases of the invention can be used in treatments to prevent the graying of a textile.

The hydrolases of the invention can be used to treat any cellulosic material, including fibers (e.g., fibers from cotton, hemp, flax or linen), sewn and unsewn fabrics, e.g., knits, wovens, denims, yarns, and toweling, made from cotton, cotton blends or natural or manmade cellulosics (e.g. originating from xylan-containing cellulose fibers such as from wood pulp) or blends thereof. Examples of blends are blends of cotton or rayon/viscose with one or more companion material such as wool, synthetic fibers (e.g. polyamide fibers, acrylic fibers, polyester fibers, polyvinyl alcohol fibers, polyvinyl chloride fibers, polyvinylidene chloride fibers, polyurethane fibers, polyurea fibers, aramid fibers), and cellulose-containing fibers (e.g. rayon/viscose, ramie, hemp, flax/linen, jute, cellulose acetate fibers, lyocell).

The textile treating processes of the invention (using hydrolases of the invention) can be used in conjunction with other textile treatments, e.g., scouring and bleaching. Scouring is the removal of non-cellulosic material from the cotton fiber, e.g., the cuticle (mainly consisting of waxes) and primary cell wall (mainly consisting of pectin, protein and xyloglucan). A proper wax removal is necessary for obtaining a high wettability. This is needed for dyeing. Removal of the primary cell walls by the processes of the invention improves wax removal and ensures a more even dyeing. Treating textiles with the processes of the invention can improve whiteness in the bleaching process. The main chemical used in scouring is sodium, hydroxide in high concentrations and at high temperatures. Bleaching comprises oxidizing the textile. Bleaching typically involves use of hydrogen peroxide as the oxidizing agent in order to obtain either a fully bleached (white) fabric or to ensure a clean shade of the dye.

The invention also provides alkaline hydrolases (hydrolases active under alkaline conditions). These have wide-ranging applications in textile processing, degumming of plant fibers (e.g., plant bast fibers), treatment of pectic wastewaters, paper-making, and coffee and tea fermentations. See, e.g., Hoondal (2002) Applied Microbiology and Biotechnology 59:409-418.

Treating Foods and Food Processing

The hydrolases of the invention have numerous applications in food processing industry. For example, in one aspect, the hydrolases of the invention are used to improve the extraction of oil from oil-rich plant material, e.g., oil-rich seeds, for example, soybean oil from soybeans, olive oil from olives, rapeseed oil from rapeseed and/or sunflower oil from sunflower seeds or rice bran oil.

The hydrolases of the invention can be used for separation of components of plant cell materials. For example, hydrolases of the invention can be used in the separation of protein-rich material (e.g., plant cells) into components, e.g., sucrose from sugar beet or starch or sugars from potato, pulp or hull fractions. In one aspect, hydrolases of the invention can be used to separate protein-rich or oil-rich crops into valuable protein and oil and hull fractions. The separation process may be performed by use of methods known in the art.

The hydrolases of the invention can be used in the preparation of fruit or vegetable juices, syrups, extracts and the like to increase yield. The hydrolases of the invention can be used in the enzymatic treatment (e.g., hydrolysis of proteins) of various plant cell wall-derived materials or waste materials, e.g. from wine or juice production, or agricultural residues such as vegetable hulls, bean hulls, sugar beet pulp, olive pulp, potato pulp, and the like. The hydrolases of the invention can be used to modify the consistency and appearance of processed fruit or vegetables. The hydrolases of the invention can be used to treat plant material to facilitate processing of plant material, including foods, facilitate purification or extraction of plant components. The hydrolases of the invention can be used to improve feed value, decrease the water binding capacity, improve the degradability in waste water plants and/or improve the conversion of plant material to ensilage, and the like.

Animal Feeds and Food or Feed Additives

The invention provides methods for treating animal feeds and foods and food or feed additives using hydrolases of the invention, animals including mammals (e.g., humans), birds, fish and the like. The invention provides animal feeds, foods, and additives comprising hydrolases of the invention. In one aspect, treating animal feeds, foods and additives using hydrolases of the invention can help in the availability of nutrients, e.g., starch, in the animal feed or additive. By breaking down difficult to digest proteins or indirectly or directly unmasking starch (or other nutrients), the hydrolase makes nutrients more accessible to other endogenous or exogenous enzymes. The hydrolase can also simply cause the release of readily digestible and easily absorbed nutrients and sugars.

Hydrolases of the present invention, in the modification of animal feed or a food, can process the food or feed either in vitro (by modifying components of the feed or food) or in vivo. Hydrolases can be added to animal feed or food compositions containing high amounts of arabinogalactans or galactans, e.g. feed or food containing plant material from soy bean, rape seed, lupin and the like. When added to the feed or food the hydrolase significantly improves the in vivo breakdown of plant cell wall material, whereby a better utilization of the plant nutrients by the animal (e.g., human) is achieved. In one aspect, the growth rate and/or feed conversion ratio (i.e. the weight of ingested feed relative to weight gain) of the animal is improved. For example a partially or indigestible galactan-comprising protein is fully or partially degraded by a hydrolase of the invention, e.g. in combination with another enzyme, e.g., beta-galactosidase, to peptides and galactose and/or galacto-oligomers. These enzyme digestion products are more digestible by the animal. Thus, hydrolases of the invention can contribute to the available energy of the feed or food. Also, by contributing to the degradation of galactan-comprising proteins, a hydrolase of the invention can improve the digestibility and uptake of carbohydrate and non-carbohydrate feed or food constituents such as protein, fat and minerals.

In another aspect, hydrolase of the invention can be supplied by expressing the enzymes directly in transgenic feed crops (as, e.g., transgenic plants, seeds and the like), such as corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the hydrolase of the invention is produced in recoverable quantities. The hydrolase can be recovered from any plant or plant part. Alternatively, the plant or plant part containing the recombinant polypeptide can be used as such for improving the quality of a food or feed, e.g., improving nutritional value, palatability, and rheological properties, or to destroy an antinutritive factor.

Paper or Pulp Treatment

The hydrolases of the invention can be in paper or pulp treatment or paper deinking. For example, in one aspect, the invention provides a paper treatment process using hydrolases of the invention. In another aspect, paper components of recycled photocopied paper during chemical and enzymatic deinking processes. In one aspect, hydrolases of the invention can be used in combination with cellulases, pectate lyases or other enzymes. The paper can be treated by the following three processes: 1) disintegration in the presence of hydrolases of the invention, 2) disintegration with a deinking chemical and hydrolases of the invention, and/or 3) disintegration after soaking with hydrolases of the invention. The recycled paper treated with hydrolases can have a higher brightness due to removal of toner particles as compared to the paper treated with just cellulase. While the invention is not limited by any particular mechanism, the effect of hydrolases of the invention may be due to its behavior as surface-active agents in pulp suspension.

The invention provides methods of treating paper and paper pulp using one or more hydrolases of the invention. The hydrolases of the invention can be used in any paper-or pulp-treating method, which are well known in the art, see, e.g., U.S. Pat. Nos. 6,241,849; 6,066,233; 5,582,681. For example, in one aspect, the invention provides a method for deinking and decolorizing a printed paper containing a dye, comprising pulping a printed paper to obtain a pulp slurry, and dislodging an ink from the pulp slurry in the presence of hydrolases of the invention (other enzymes can also be added). In another aspect, the invention provides a method for enhancing the freeness of pulp, e.g., pulp made from secondary fiber, by adding an enzymatic mixture comprising hydrolases of the invention (can also include other enzymes, e.g., pectate lyase, cellulase, amylase or glucoamylase enzymes) to the pulp and treating under conditions to cause a reaction to produce an enzymatically treated pulp. The freeness of the enzymatically treated pulp is increased from the initial freeness of the secondary fiber pulp without a loss in brightness.

Waste Treatment

The hydrolases of the invention can be used in a variety of other industrial applications, e.g., in waste treatment. For example, in one aspect, the invention provides a solid waste digestion process using hydrolases of the invention. The methods can comprise reducing the mass and volume of substantially untreated solid waste. Solid waste can be treated with an enzymatic digestive process in the presence of an enzymatic solution (including hydrolases of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In addition, the hydrolases (e.g., proteases) of the invention can be used in the animal rendering industry, to e.g., get rid of feathers, e.g., as described by Yamamura (2002) Biochem. Biophys. Res. Com. 294:1138-1143. Alkaline proteases of the invention can also be used in the production of proteinaceous fodder from waste feathers or keratin-containing materials, e.g., as described by Gupta (2002) Appl. Microbiol. Biotechnol. 59:15-32.

Lubricants and Hydraulic Oils

The methods and compositions (enzymes of the invention, e.g., esterases, acylases, lipases, phospholipases or hydrolases of the invention) of the invention can be used to prepare lubricants, such as hydraulic oils. Thus, the invention also provides lubricants and hydraulic oils comprising a hydrolase of the invention. The purpose of a lubricant of the invention is to minimize friction and wear of metals. Lubricants can further comprise base fluids and additives improving the lubricative properties. See, e.g., U.S. Pat. No. 5,747,434.

Interesterification

In one aspect, the methods and compositions of the present invention can be used to modify the properties of triglyceride mixtures, and, in one aspect, their consistency. In one aspect, an enzyme of the invention can be used in the presence of a catalyst such as sodium metal or sodium methoxide to promote acyl migration between glyceride molecules such that the products consist of glyceride mixtures in which the fatty acyl residues are randomly distributed among the glyceride molecules.

In one aspect, the enzymes of the invention can be used to produce interesterification products in the reaction where hydrolysis of fat is minimized so that lipase-catalyzed interesterification becomes the dominant reaction. These conditions may include, for example, restricting the amount of water in the system.

In one aspect, enzymes of the invention can be used to catalyze interesterification reaction using mixtures of triglycerides and free fatty acids, as described, e.g., in EP 0 093 602 B2. In these cases, free fatty acid can be exchanged with the acyl groups of the triglycerides to produce new triglycerides enriched in the added fatty acid. In one aspect, 1,3-specific lipases of the invention can be used to confine the reaction to the 1-and 3-positions of the glycerides, which allow to obtain a mixture of triglycerides unobtainable by chemical interesterification or reaction with a non-specific lipase. In one aspect, non-specific lipases are used to attain results similar to chemical interesterification.

The ability to produce novel triglyceride mixtures using positionally specific lipases of the invention is useful to the oils and fats industry because some of these mixtures have valuable properties. For example, 1,3-specific lipase-catalyzed interesterification of 1,3-dipalmitoyl-2-monoleine (POP), which is the major triglyceride of the mid-fraction of palm oil, with either stearic acid or tristearin gives products enriched in the valuable 1-palmitoyl-3-stearoyl-2-monoleine (POSt) and 1,3-distearoyl-2-monoleine (StOSt). POSt and StOSt are the important components of cocoa butter. Thus, one aspect of the invention provides an interesterification reaction to produce cocoa butter equivalents from cheap starting materials.

In one aspect, the invention provides a method of production of a hard fat replacer using the 1,3-specific lipases of the invention. In one aspect, a hard fat replacer comprises a mixture of palm mid-fraction and StOSt, POSt or StOSt/POSt of at least 85% purity.

Oral Care Products

The invention provides oral care product comprising hydrolases of the invention. Exemplary oral care products include toothpastes, dental creams, gels or tooth powders, odontics, mouth washes, pre-or post brushing rinse formulations, chewing gums, lozenges, or candy. See, e.g., U.S. Pat. No. 6,264,925.

Brewing and Fermenting

The invention provides methods of brewing (e.g., fermenting) beer comprising hydrolases of the invention. In one exemplary process, starch-containing raw materials are disintegrated and processed to form a malt. A hydrolase of the invention is used at any point in the fermentation process. For example, hydrolases (e.g., proteases) of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15 to 25° C. for 3 to 6 days when enzyme synthesis is stimulated under the control of gibberellins. In one aspect, hydrolases of the invention are added at this (or any other) stage of the process. The action of hydrolases results in an increase in fermentable reducing sugars. This can be expressed as the diastatic power, DP, which can rise from around 80 to 190 in 5 days at 12° C. Hydrolases (e.g., proteases) of the invention can be used in any beer or alcoholic beverage producing process, as described, e.g., in U.S. Pat. Nos. 5,762,991; 5,536,650; 5,405, 624; 5,021,246; 4,788,066.

Medical and Research Applications

Hydrolases, (e.g., proteases) of the invention can be used for cell isolation from tissue for cellular therapies in the same manner that collagenases. For example, metallo-endoproteinases and other enzymes of the invention that can cleave collagen into smaller peptide fragments, can be used as "liberase enzymes" for tissue dissociation and to improve the health of isolated cells. "Liberase enzymes" can replace traditional collagenase. Proteases of the invention having collagenase I, collagenase II, clostripain and/or neutral protease activity can be used for tissue dissociation. In one aspect, for tissue dissociation, collagenase isoforms of the invention are blended with each other, and, optionally, with a neutral protease. In one aspect, the neutral protease is a neutral protease dispase and/or the neutral protease thermolysin.

Additionally, proteases of the invention can be used as antimicrobial agents, due to their bacteriolytic properties, as described, e.g., in Li, S. et. al. Bacteriolytic Activity and Specificity of Achromobacter b-Lytic Protease, J. Biochem. 124, 332-339 (1998).

Proteases of the invention can also be used therapeutically to cleave and destroy specific proteins. Potential targets include toxin proteins, such as Anthrax, *Clostridium botulinum*, Ricin, and essential viral or cancer cell proteins.

Proteases of the invention can also be used in disinfectants, as described, e.g., in J. Gen Microbiol (1991) 137(5): 1145-1153; Science (2001) 249:2170-2172.

Additional medical uses of the proteases of the invention include lipoma removal, wound debraidment and scar prevention (collagenases), debriding chronic dermal ulcers and severely burned areas.

Enzymes of the invention (e.g., esterases, proteases, etc., of the invention) can be used to in sterile enzymatic debriding compositions, e.g., ointments, in one aspect, containing about 250 collagenase units per gram. White petrolatum USP can be a carrier. In one aspect, enzymes (e.g., proteases) of the invention can be used in indications similar to Santyl® Ointment (BTC, Lynbrook, N.Y.). Proteases of the invention can also be used in alginate dressings, antimicrobial barrier dressings, burn dressings, compression bandages, diagnostic tools, gel dressings, hydro-selective dressings, hydrocellular (foam) dressings, hydrocolloid Dressings, I.V dressings, incise drapes, low adherent dressings, odor absorbing dressings, paste bandages, post operative dressings, scar management, skin care, transparent film dressings and/or wound closure. Proteases of the invention can be used in wound cleansing, wound bed preparation, to treat pressure ulcers, leg ulcers, burns, diabetic foot ulcers, scars, IV fixation, surgical wounds and minor wounds.

Additionally, enzymes of the invention can be used in proteomics and lab work in general. For instance, proteases can be used in the same manner as DNA restriction enzymes.

Other Industrial Applications

The invention also includes a method of increasing the flow of production fluids from a subterranean formation by removing a viscous, protein-containing, damaging fluid formed during production operations and found within the subterranean formation which surrounds a completed well bore comprising allowing production fluids to flow from the well bore; reducing the flow of production fluids from the formation below expected flow rates; formulating an enzyme treatment (comprising an enzyme of the invention) by blending together an aqueous fluid and a polypeptide of the invention; pumping the enzyme treatment to a desired location within the well bore;

allowing the enzyme treatment to degrade the viscous, protein-containing, damaging fluid, whereby the fluid can be removed from the subterranean formation to the well surface; and wherein the enzyme treatment is effective to attack protein in cell walls.

Hydrolases of the invention can be used for peptide synthesis, in the leather industry, e.g., for hide processing, e.g., in hair removal and/or bating, for waste management, e.g., removal of hair from drains, in the photography industry, e.g., for silver recovery from film, in the medical industry, e.g., as discussed above, e.g., for treatment of burns, wounds, carbuncles, furuncles and deep abscesses or to dissolve blood clots by dissolving fibrin, for silk degumming.

In other aspects, enzymes of the invention can be used as flavor enhancers in, for example, cheese and pet food, as described, e.g., in Pommer, K., Investigating the impact of enzymes on pet food palatability, Petfood Industry, May 2002, 10-11.

In yet another embodiment of the invention, enzymes of the invention can be used to increase starch yield from corn wet milling, as described, e.g., in Johnston, D. B., and Singh, V. Use of proteases to Reduce Steep Time and $SO_2$ requirements in a corn wet-milling process, Cereal Chem. 78(4):405-411.

In other aspects, enzymes of the invention can be used in biodefense (e.g., destruction of spores or bacteria). Use of enzymes in biodefense applications offer a significant benefit, in that they can be very rapidly developed against any currently unknown biological warfare agents of the future. In addition, proteases of the invention can be used for decontamination of affected environments.

Additionally, enzymes of the invention can be used in biofilm degradation, in biomass conversion to ethanol, and/or in the personal care and cosmetics industry.

Enzymes of the invention can also be used to enhance enantioselectivity, as described, e.g., in Arisawa, A. et. al. *Streptomyces* Serine Protease (DHP-A) as a New Biocatalyst Capable of Forming Chiral Intermediates of 1,4-Diohydropyridine Calcium Antagonists. Appl Environ Microbiol 2002 June; 68(6):2716-2725; Haring, D. et. al. Semisynthetic Enzymes in Asymmetric Synthesis:Enantioselective Reduction of Racemic Hydroperoxides Catalyzed by Seleno-Subtilisin. J. Org. Chem. 1999, 64:832-835.

EXAMPLES

Example 1

Exemplary Lipase Assays

The following example describes exemplary assays to screen for lipase activity. In one aspect, these exemplary assays can be used as routine screens to determine if a polypeptide is within the scope of the invention. Such assays include use of pH indicator compounds to detect cleavage of fatty acids from triglycerides, spectrophotometric methods, HPLC, GC, MS, TLC and others. Jaeger (1994) FEMS Microbiol. Rev. 15:29-63; Ader (1997) Methods Enzymol. 286:351-386; Vorderwülbecke (1992) Enzyme Microb. Technol. 14:631-639; Renard (1987) Lipids 22: 539-541.

In one aspect, the methods of the invention screen for regio-selective lipases, e.g., Sn-1, Sn-3 and/or Sn-3 regioselective lipases. In one aspect, the substrates 1,3-diamide and 1,3-diether TAG analogues are used to target, or select for, Sn-2 selective lipases. In one aspect, the methods of the invention screen for lipases that exhibit regioselectivity for the 2-position of lipids, e.g., TAGs. Structured synthesis of lipids using Sn-2 selective lipases can be useful for the synthesis of a variety of TAGs, including 1,3-diacylglycerides (1,3-DAGs) and components of cocoa butter.

In one aspect, regio-selective lipases, including Sn-2 selective lipases, are characterized for regioselectivity using rigorous analytical methods. This can eliminate false results due to acyl migration. In one aspect, lipases are tested for Sn2 specificity using analytical methods such as NMR spectroscopy. Also, a structured triacylglyceride of the ABA-type (where A and B denote fatty acids distributed along the glycerol backbone) can be subjected to hydrolysis or alcoholysis using lipases (e.g. of the invention) followed by analysis of the partial glycerides and fatty acid (esters) formed. Alcoholysis conditions at controlled water activity, e.g. using primary alcohols such as methanol or ethanol are preferred as undesired acyl migration can be avoided need different references. Sn-2 selectivity of lipases was reported, however, the extent of sn-2 selectivity was very low (Briand (1995) Eur. J. Biochem. 228:169-175; Rogalska (1993) Chirality 5, 24-30.

In one aspect, regio-selective lipases are assayed for their regio-specificity (Sn2 versus Sn1/Sn3 versus Sn1,3) on appropriate lipids, such as tripalmitin, tristearin, triolein, tricaprylin, and trilaurin, and also for their fatty acid specificity.

Screening for Lipase/Esterase Activity

Colonies are picked with sterile toothpicks and used to singly inoculate each of the wells of 96-well microtiter plates. The wells contained 250 µL of LB media with 100 µg/mL ampicillin, 80 µg/mL methicillin, and 10% v/v glycerol (LB Amp/Meth, glycerol). The cells were grown overnight at 37° C. without shaking. This constituted generation of the "Source GenBank." Each well of the Source GenBank thus contained a stock culture of *E. coli* cells, each of which contained a pBluescript with a unique DNA insert.

Plates of the source GenBank were used to multiply inoculate a single plate (the "condensed plate") containing in each well 200 µL of LB Amp/Meth, glycerol. This step was performed using the High Density Replicating Tool (HDRT) of the Beckman Biomek with a 1% bleach, water, isopropanol, air-dry sterilization cycle in between each inoculation. Each well of the condensed plate thus contained 10 to 12 different pBluescript clones from each of the source library plates. The condensed plate was grown for 16 hours at 37° C. and then used to inoculate two white 96-well Polyfiltronics microtiter daughter plates containing in each well 250 µL of LB Amp/ Meth (no glycerol). The original condensed plate was put in storage −80° C. The two condensed daughter plates were incubated at 37° C. for 18 hours.

The short chain esterase '600 µM substrate stock solution' was prepared as follows: 25 mg of each of the following compounds was dissolved in the appropriate volume of DMSO to yield a 25.2 mM solution. The compounds used were 4-methylumbelliferyl proprionoate, 4-methylumbelliferyl butyrate, and 4-methylumbelliferyl heptanoate. Two hundred fifty microliters of each DMSO solution was added to ca 9 mL of 50 mM, pH 7.5 HEPES buffer which contained 0.6% of Triton X-100 and 0.6 mg per mL of dodecyl maltoside (Anatrace, Maumee, Ohio). The volume was taken to 10.5 mL with the above HEPES buffer to yield a slightly cloudy suspension.

The long chain '600 µM substrate stock solution' was prepared as follows: 25 mg of each of the following compounds was dissolved in DMSO to 25.2 mM as above. The compounds used were 4-methylumbelliferyl elaidate, 4-methylumbelliferyl palmitate, 4-methylumbelliferyl oleate, and 4-methylumbelliferyl stearate. All required brief warming in a 70° C. bath to achieve dissolution. Two hundred fifty microliters of each DMSO solution was added to the HEPES buffer and diluted to 10.5 mL as above. All seven umbelliferones were obtained from Sigma Chemical Co. (St. Louis, Mo.).

Fifty µL of the long chain esterase or short chain esterase '600 µM substrate stock solution' was added to each of the wells of a white condensed plate using the Biomek to yield a final concentration of substrate of about 100 µM. The fluorescence values were recorded (excitation=326 nm, emission=450 nm) on a plate-reading fluorometer immediately after addition of the substrate. The plate was incubated at 70° C. for 60 minutes in the case of the long chain substrates, and 30 minutes at RT in the case of the short chain substrates. The fluorescence values were recorded again. The initial and final fluorescence values were compared to determine if an active clone was present.

To isolate the individual clone which carried the activity, the Source GenBank plates were thawed and the individual wells used to singly inoculate a new plate containing LB Amp/Meth. As above, the plate was incubated at 37° C. to grow the cells, 50 µL of 600 µM substrate stock solution was added using the Biomek and the fluorescence was determined. Once the active well from the source plate was identified, cells from this active well were streaked on agar with LB/Amp/Meth and grown overnight at 37° C. to obtain single colonies. Eight single colonies were picked with a sterile toothpick and used to singly inoculate the wells of a 96-well microtiter plate. The wells contained 250 µL of LB Amp/Meth. The cells were grown overnight at 37° C. without shaking. A 200 µL aliquot was removed from each well and assayed with the appropriate long or short chain substrates as above. The most active clone was identified and the remaining 50 µL of culture was used to streak an agar plate with LB/Amp/Meth. Eight single colonies were picked, grown and assayed as above. The most active clone was used to inoculate 3 mL cultures of LB/Amp/Meth, which were grown overnight. The plasmid DNA was isolated from the cultures and utilized for sequencing.

Example 2

Exemplary Structured Lipid Synthesis Methods

The following example describes exemplary structured lipid synthesis methods of the invention using lipases of the invention.

Figure 7:
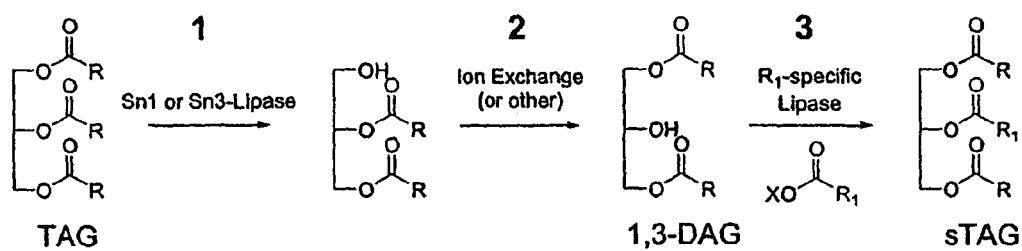
FIG. 7 illustrates an exemplary method of the invention, a "Forced Migration Methodology" for the structured synthesis of lipids, as described in detail in Example 2, below.

In one aspect, the invention provides a "Forced Migration Methodology" for the structured synthesis of lipids using the lipases of the invention. This method provides for the efficient synthesis of a variety of structured lipids, including 1,3-DAGs and components of cocoa butter, as illustrated in FIG. 7. In one aspect, the method for producing structured lipids, in this example a structured triacylglyceride (sTAG), comprises three major steps:
1. Regiospecific hydrolysis or alcoholysis (e.g. ethanolysis) of a TAG using a Sn1-specific or Sn3-specific lipases to yield a 2, 3 or 1,2-DAG, respectively;
2. Promotion of acyl migration in a purified or unpurified DAG under kinetically-controlled conditions using ion-exchange resins or other method(s), resulting in the structured 1,3-DAG; and
3. Fatty acid-specific lipase catalyzed addition of a fatty acid or a fatty acid derivative, such as a fatty acid ethyl ester or vinyl ester, at the Sn2 position, yielding the sTAG.

This route can provide access to two target groups of lipids, 1,3-DAGs and sTAGs with the same set of enzymes and methodology. The method can use lipases that have Sn1 and/or Sn3 regiospecificity; such enzymes are commercially available (*Rhizopus delemar* (Amano, Japan) and *Rhizomucor miehei* (Novozymes, Denmark In one aspect, *Rhizopus* sp. lipases and *Rhizomucor miehei* lipases are used. These lipases are known to exhibit higher specificity for hydrolysis of fatty acids in the Sn1 position compared with the Sn3 position. In one aspect, the methods further comprise use of these *Rhizopus* and *Rhizomucor miehei* lipases to confirm Step 1, of FIG. 7, i.e., the regiospecific hydrolysis or alcoholysis (e.g. ethanolysis) of a TAG using an Sn1-specific or Sn3-specific lipase to yield a 2, 3 or 1,2-DAG, respectively.

Figure 27:
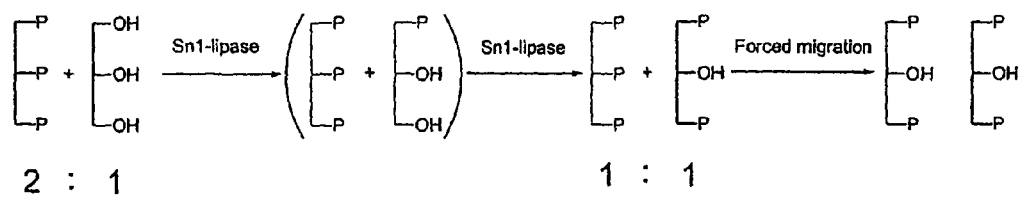
FIG. 27 illustrates an exemplary forced migration reaction of the invention, as discussed below.

In one aspect, the invention provides a forced migration method supplemented with glycerol. Addition of glycerol to the enzyme reaction prior to the treatment with anion exchange resin (or other migration catalysts) can be a way to increase yields of 1,3 DAGs in forced migration reactions, as illustrated in FIG. 27.

In one aspect, the methods further comprise confirmation of Step 2, FIG. 7, by treatment of purified or unpurified 1,2-DAG or 2,3-DAG with an ion-exchange resin, for example, an ion-exchange column, under a variety of conditions. Major variables include the nature of the ion-exchange resin, pH, flow rates, buffer type and ionic strengths. Alternative methods of promoting acyl migration can be used. In one aspect, the acyl migration can be performed under non-equilibrium conditions, e.g., such that the end product contains greater ratios of one product over another, for example, such that the end product contains a 2:1 ratio of 1,3-DAG to 2,3-DAG. Substrates for the Step 2 validation studies are available commercially.

In one aspect, acyl migration in 2,3-DAGs (or 1,2-DAGs) is promoted under kinetic conditions such that the final product is a purified 1,3-DAG in greater than about a 70% yield.

In one aspect, Step 3, FIG. 7, uses a lipase that is fatty acid specific, but there are no regiospecific requirements given a pure 1,3-DAG as substrate. The lipase from *Geotrichium candidum* exhibits a very high specificity for fatty acids that have Δ9 unsaturation. This enzyme is readily available and can be utilized to confirm Step 3.

Example 3

Exemplary Structured Synthesis of Cocoa Butter Alternatives (CBAs)

The following example describes exemplary structured lipid synthesis methods of the invention using the lipases of the invention. This example describes the structured synthesis of triacylglycerides (sTAGs) as cocoa butter alternatives (CBAs).

Natural cocoa butter consists mostly of three TAG: 1,3-dipalmitoyl-2-oleoylglycerol (POP), 1,3-distearoyl-2-oleoylglycerol (SOS) and 1-palmitoyl-2-oleoyl-3-stearoylglycerol (POS). The relative proportions of these three TAGs differ somewhat depending upon the source of cocoa butter, but are approximately 21:31:48 (POP:SOS:POS). The methods of the invention provide for the structured synthesis of a cocoa butter alternatives having any proportion of POP:SOS:POS, including the natural 21:31:48 POP:SOS:POS. The methods of the invention provide for the structured synthesis related TAGs, e.g., 1-oleoyl-2,3-dimyristoylglycerol (OMM). The methods of the invention also provide for the selective processing of natural cocoa butter using the lipases of the invention.

In one aspect, both the Sn2 lipase and the methods outlined above (including Example 2) are used in the synthesis of key structured lipids of CBAs. Lipases can be assayed for their regiospecificity (Sn2 versus Sn1/Sn3 versus Sn1,3) on appropriate lipids, such as tripalmitin, tristearin, triolein, tricaprolein, and trilaurein. Lipases also can be assayed for their fatty acid specificity.

Example 4

Exemplary Structured Synthesis of Nutraceuticals

The following example describes exemplary structured lipid synthesis methods of the invention for making nutraceuticals using the lipases of the invention.

Figure 8:
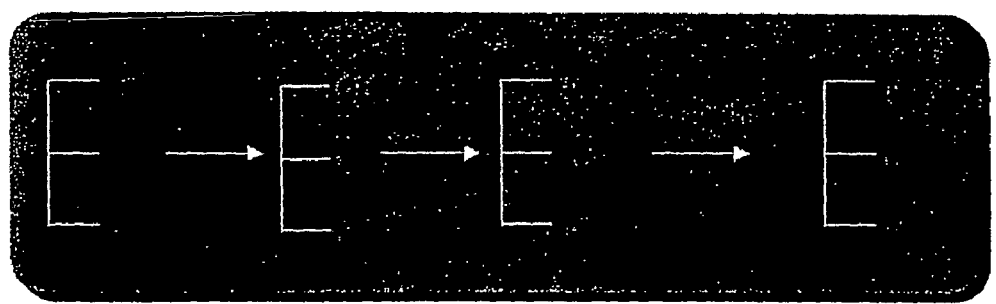
FIG. 8 illustrates an exemplary method comprising use of lipases of the invention to synthesize cocoa butter alternatives, as described in detail below.

In one aspect, 1,3-DAGs are synthesized for use in nutraceuticals. 1,3-DAGs are the products of the first step of the Sn2 lipase synthesis of sTAGs shown in FIG. 6 and first two steps of the synthesis of structured lipids as shown in FIG. 7 and FIG. 8. Routine assaying of lipases for Sn2 versus Sn1 or Sn3 specificity can provide the data to determine the optimum lipases and methodology for different 1,3-DAG and nutraceutical synthesis applications.

Figure 9:
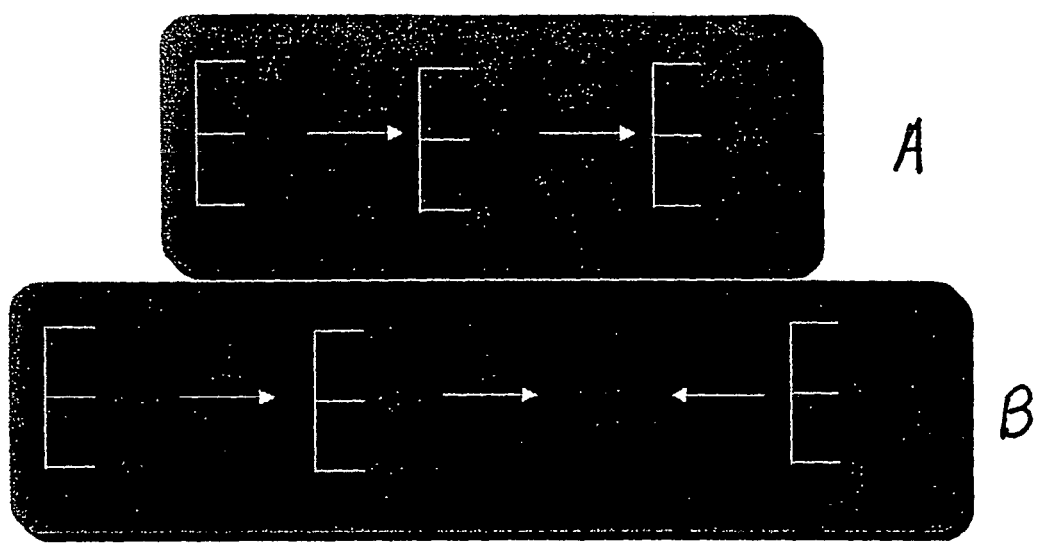
FIG. 9A and FIG. 9B illustrate exemplary methods of the invention comprising synthesizing PUFA-containing sTAGs (FIG. 9A, top) and 2-PUPA sMAGs and purified PUFAs (FIG. 9B, bottom).

In one aspect, poly-unsaturated fatty acids (PUFAs) are made using the methods and lipases of the invention, e.g., using a protocol as set forth in FIG. 9, bottom. PUFAs are themselves valuable commodities and can be extracted from PUFA-containing fat sources, such as fish oil, using PUFA-specific lipases of the invention. In one aspect, the invention uses enzymes that can distinguish between esters of different PUFAs, e.g. docosahexaenoic acid (DHA) versus eicosapentaenoic acid (EPA), facilitating the development of highly purified products (S. Wongsakul et al., *Eur. J. Lipid Sci. Technol.* 105 (2003) 68-73). Lipases can be tested for their specificities on a variety of PUFA esters and glycerol esters.

Example 5

Exemplary Structured Synthesis of Lipids Containing Poly-Unsaturated Fatty Acids The following example describes exemplary structured lipid synthesis methods of the invention for making lipids containing poly-unsaturated fatty acids (PUFAs) using the lipases of the invention. These PUFA-containing lipids can be used in foods, feeds, cosmetics, pharmaceuticals and drug delivery agents, nutraceuticals and the like.

In one aspect, fish oil is a starting material, since in fish oil the majority of fatty acids at the 2 position are PUFAs. In one aspect, the methods comprise a 1,3-lipase-catalyzed interesterification of fish oil with medium-chain fatty acid esters to form MLM-type lipids (triacylglycerols (TAG) can be of types MML, MLM, MLL, and LML (M, medium-chain fatty acid; L, long-chain fatty acid, see, e.g., Kurvinen (2001) Lipids 36:1377-1382)).

In one aspect the invention provides methods for making PUFA-containing sTAGs, as illustrated at the top of FIG. 9 (FIG. 9A), and 2-PUFA sMAGs and purified PUFAs, as illustrated at the bottom of FIG. 9 (FIG. 9B). Any appropriate starting oil can be used. In one aspect, if it is more economic to use fish-oil fatty acids instead of purified PUFAs, lipases with specificity for fatty acid B (in FIG. 9A, top) and PUFAs can be used. Lipases can be screened for fatty acid specificity on simple esters and glycerol esters. In one aspect, 2-PUFA MAGs are synthesized from fish oil using either a Sn1,3-lipase (see FIG. 9B) or a non-regiospecific lipase that does not cleave PUFA esters.

Example 6

Exemplary Growth-Kill Assay

The following example describes an exemplary Growth-Kill assay for testing the activity of the lipases of the invention. See, e.g., Chem. Communication (2002) 1428-1429.

The Growth-Kill assay provides a method for in vivo selection of enzymes, e.g. lipases, or mutants thereof, with desirable properties. The assay combines two components, a growth component and a kill component. The first of these is a substrate from which the enzyme, e.g. lipase, liberates an element which allows the host organisms to grow, e.g. a carbon source. The second of these is a substrate from which the enzyme, e.g. lipase, liberates an element which prevents the host organism from growing or kills the host organism, e.g. an antibiotic.

Figure 11:
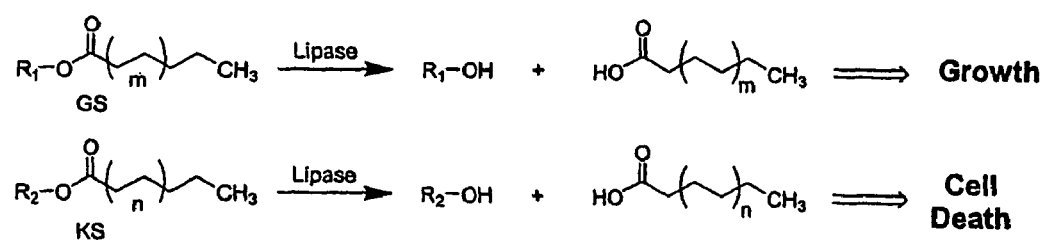
FIG. 11 illustrates an exemplary growth-kill assay, as discussed in Example 6, below.

The invention provides methods of modifying a nucleic acid encoding a lipase to generate an enzyme with modified properties. A Growth-Kill assay can be used to discriminate between two fatty acids, to determine if a lipase has altered enzyme specificity, to determine if a lipase is within the scope of the invention, and the like. An exemplary Growth-Kill assay is outlined in FIG. 11, where R1 is a growth substrate for the screening host and R2 is a substance that is toxic to the cell and kills the host if released from the ester. In one aspect, growth substrates (1-acyl glycerol esters) and kill substrates (3-acyl chloramphenicol esters) are used

Example 7

Protocol for the Synthesis of 1,3-diglyceride

The following example describes an exemplary protocol used to practice the compositions (the lipases) and the methods of the invention. These exemplary protocols can also be used to determine if a lipase is within the scope of the invention. In one aspect, an exemplary protocol for the synthesis of 1,3-diglyceride (1,3-DG) and structured lipids using lipases of the invention is described.

In one aspect, glycerol and free fatty acid (FFA) or fatty acid vinyl ester (PAVE) are esterified immobilized glycerol (see, e.g., J. Am. Oil Chem. Soc., 1992, 69:955-960). The immobilized glycerol can be on a silica gel. In one exemplary assay, Lipozyme RM IM™ (an immobilized 1,3-specific lipase, Novozymes, Denmark), with MTBE, at room temperature was used. This has the advantage of high yield and purity of 1,3-DG, and fast reaction. However, MTBE is not allowed in food use and there is difficulty in separation of immobilized enzyme and silica gel In one aspect, the esterification is done using non-immobilized glycerol. In one exemplary assay, esterification of glycerol and fatty acid (FFA) or fatty acid vinyl ester (FAVE) is in a solvent-free/organic solvent with an immobilized lipase from *Candida antarctica* type B (CAL-B), a lipase from *Rhizopus delemar* immobilized on EP100 (D-EP100), and Lipozyme RM IM™ (Novozymes, Denmark), at 0° C. or room temperature (RT). One advantage of this exemplary protocol is the solvent-free condition; it allows ease of separation of immobilized enzyme and with a further purification step, a moderate-high yield.

In one aspect, alcoholysis and hydrolysis of triglycerides (TG) is accomplished using 1,3-regiospecific lipases, D-EP100 and Lipozyme RM IM™ (Novozymes, Denmark), organic solvents, preferentially at controlled water activity. In this reaction, the substrates (natural oil) are cheap and the reaction provides an acceptable yield. Most DAG formed is 1,2(2,3)-DAG.

In one aspect, an exemplary reaction involved induction of acyl migration of 1,2(2,3)-DAG. Most DAG obtained from alcoholysis and hydrolysis of TAG is 1,2 (2,3)-DaG. It is thus necessary to induce the acyl migration of 1,2(2,3)-DAG to 1,3-DAG. Several factors were studied, including ion-exchangers, acid or base, heat, carrier, water activity. One exemplary reaction involved the esterification between 1,3-DAG and FFA or FAVE using an sn2-specific enzyme or a non-regiospecific lipase but specific to fatty acid change length or specific fatty acid.

Esterification Using Immobilized Glycerol 1,3-DAG was synthesized from glycerol, 1 mmol, immobilized on 4 g silica gel) and vinyl laurate (2 mmol) in 8 ml methyl-tert-butyl ether (MTBE) at room temperature using Lipozyme RM IM™ (Novozymes, Denmark) (10% based on glycerol weight) as catalyst (Matthias et al. 1992???). The reaction was carried out in a 10-ml vial and the reaction mixture was mixed by magnetic stirrer (500 rpm). After 24 hours (h), enzyme was separated from the reaction mixture by filtration to stop the reaction. The filtrate was evaporated under vacuum. 1,3-DAG in oily residue was recovered and purified by crystallization in dry methanol at 4° C. followed by filtration. See, e.g., J. Am. Oil Chem. Soc., 1992, 69:955-960).

Esterification Using Non-Immobilized Glycerol 1,3-DAG was synthesized by esterification of glycerol (1 mmol) and FFA or FAVE (2 mmol) in a solvent-free condition or in organic solvent at 0° C. using CAL-B (10% based on glycerol weight) as catalyst. The reaction was carried out in a 4-ml vial and the reaction mixture was mixed by magnetic stirrer (400 rpm). Activated molecular sieve was added in a reaction with FFA to remove produced water from the reaction mixture. In some reactions organic solvent (2 ml) was added to the reaction mixture to is dissolve a solid FFA. The reaction was stopped by dissolving the reaction mixture in n-hexane (in case of a solvent-free reaction condition) and centrifuged to separate immobilized enzyme from the reaction mixture. The 1,3-DAG was recovered and purified by crystallization at −20° C. If high contents of MAG were present, a recrystallization in dry methanol at −20° C. afforded pure 1,3-DAG. Samples (10 µl) were periodically withdrawn during the reaction to determine the acylglycerol composition. Samples were pretreated before analysis by adding 0.3 ml Folsh's solution (chloroform:methanol, 2:1 by vol) and 0.3 ml distilled water, mixed for 30 sec, followed by centrifuging (10000 rpm, 2 min). Organic layer was used for analysis by IATROSCAN™ (Shell-usa, Fredericksburg Va.).

Alcoholysis and Hydrolysis of TAG

TAG (3 mmol) was dissolved in organic solvent (2 ml) and pre-equilibrated over a saturated-salt solution at $a_w$ 0.11 for 48 h (only for alcoholysis reaction). Dry ethanol or water (3 mmol) was added and the reaction mixture was incubated at 40° C. for 15 min. Immobilized lipase (10% based on TAG weight) was added to start the reaction. The reaction was carried out in a 4-ml screw-capped vial and the reaction mixture was mixed by magnetic stirrer (400 rpm). An aliquot of the reaction mixture was periodically withdrawn and diluted with chloroform to appropriate dilution, followed by analysis with IATROSCAN™ (Shell-usa, Fredericksburg Va.) to determine acylglycerol composition. Immobilized lipase was separated from the reaction mixture after 48 h by centrifugation to stop the reaction.

Induction of Acyl Migration

Effect of temperature, FFA (oleic acid), carrier (celite) and ion-exchanger on acyl migration of 1,2-dipalmitin (1,2-DP, this also includes the stereoisomer 2,3-DP) were studied. 1,2-DP was dissolved in n-hexane (8 mg/ml). Oleic acid (2-4 mmol) or celite (8 mg) or ion-exchanger (10-100 mg) was added directly to the reaction mixture. All reactions were carried out in a 1.5-ml Eppendorf reaction vial with shaking (1400 rpm) at room temperature (25° C.), except when testing effect of temperature, then the reaction was carried out at 40 or 60° C.

Synthesis of Structured triglycerides (ST) from 1,3-diglycerides (1,3-DAG) and Free Fatty Acid or Fatty Acid Vinyl Este Structured triglycerides (ST) was synthesized by esterification of 1,3-DAG and oleic acid (OA) or oleic acid vinyl ester (OAVE) in n-hexane at 60° C. using immobilized lipase from *Pseudomonas* sp. (Amano PS-D, Amano Enzyme USA, Elgin, Ill.) as biocatalyst. 0.1 mmol of 1,3-DG (45.7 mg of 1,3-dilaurin or 34.4 mg of 1,3-dicaprylin) and 0.2 mmol of OA (28.2 mg) or OAVE (60.2 mg) was dissolved in 1 ml n-hexane in a 2-ml screw-capped vial. Activated molecular sieve was added when OA was used as acyl donor. The reaction was started by addition of PS-D (10% weight of 1,3-DG). The vials were shaken at 1400 rpm at 60° C. An aliquot of reaction mixtures was withdrawn for analysis with IATROSCAN™ (Shell-usa, Fredericksburg Va.). ST thus obtained was purified on TLC plate and the TAG band was scrapped of and methylated followed by GC analysis.

Acylglycerol composition was determined by IATROSCAN™ (Shell-usa, Fredericksburg Va.) analysis (TLC-FID). Total fatty acid composition of ABA-ST was determined by GC analysis of corresponding methylesters. Purity of 1,3-DAG was confirmed by $^1$H-NMR spectroscopy.

Determination of Fatty Acid Composition by GC Analysis 10 mg of 1,3-DG was methylated with 0.5% NaOH in methanol (500 µl) and then incubated for 10 min at 60° C. The methylesters were extracted with n-hexane (400 µl) for 1 min. The n-hexane layer was washed with 200 µl distilled water and dried over anhydrous sodium sulfate. Analysis was carried out with a Hewlett-Packard 5890 (series II) gas chromatograph (GS) (Hewlett-Packard, USA) on a FFAP column (Permabond FFAP-DF-0.25, 25 m×0.25 mm i.d., Macherey-Nagel GmbH, Düren, Germany). Hydrogen was used as the carrier gas. The temperature program used was 150° C. (4° C./min, 0.50 min), 170° C. (5° C./min), 195° C. (10° C./min) and 215° C. (9.50 min). Injector and detector temperatures were 250° C. Response factors were determined using a standard mixture of fatty acid methylesters Determination of Glyceride Composition by TLC/FID Analysis Changes in glyceride composition during reaction were quantitatively determined using Iatroscan analytical method. Before analysis, a blank of the chromarod was scanned. After treating chromarod with boric acid (3%) and drying for 5 min, 1 µl of the reaction medium (diluted in chloroform at appropriate dilution) is spotted onto the chromarod and the spotted sample was developed for 10 cm in a mixture of benzene:chloroform:acetic acid (50:30:0.5, by vol). After drying, the chromarod in an oven at 110° C. for 5 min, scanning is performed at a hydrogen flow rate of 160 ml/min and an air flow rate of 2.0 l/min to produce a chromatogram.

HPLC Separation of Triacylglycerols

The composition of the triacylglycerols formed during the enzymatic esterification was characterized by HPLC using a nucleosil $C_{18}$ column, (5 µm, 250×4 mm, Sykam, Gilching, Germany) and an evaporative light scattering detector (ELSD) (Polymer labs) at a flow rate of 1.5 ml/min. The purpose of ELSD is to complement ultraviolet (UV) detection of solutes, and to detect solutes, which do not absorb UV light such as medium-chain triglycerides. The principle of ELSD applies to all solutes having a lower volatility than the mobile phase. Elution was performed using a gradient elution system of acetonitrile and dichloromethane (70% to 55% acetonitrile over 10 min, followed by 55% to 70% acetonitrile over 8 minute).

Regiospecific Analysis of Triglycerides

The regiospecific analysis of oil was conducted by Grignard degradation with allylmagnesium bromide followed by gas chromatograph (GS) analysis. 20 mg of TG was dissolved in dry diethyl ether (2 ml). 800 µl of allyl magnesium bromide solution (1M) was added, and the mixture was shaken for 30 second, then 300 µl glacial acetic acid was added, followed by 5 ml of 0.4-M boric acid to stop the reaction. A mixture of deacylated products was extracted with diethyl ether. This extract was washed with 5 ml solution of aqueous boric acid (0.4 M)/aqueous NaHCO$_3$ (2%), 50:50 (vol/vol). The ether layer was directly subjected to TLC plate, which was impregnated with boric acid, to isolate each fraction of deacylated products. The plate was developed with a chloroform/acetone/acetic acid solution (85:15:1, by vol) as developing system. The 1-MG bands were scraped off and methylated to determine their fatty acid composition using the same method described above. The molar percentage of fatty acid composition at sn 1(3)-and sn 2-positions of the produced TG were calculated. Equation for % FA in sn2-position is shown below:

$$[\% FA_{sn2\text{-}position}] = 3[\% FA_{TG}] - 2[\% FA_{1\text{-}MG}]$$

where [% FA$_{1\text{-}MG}$] and [% FA$_{TG}$] indicated for each fatty acid, its percentage found in 1-monoglyceride and in triglycerides, respectively.

Dicaprylin (1,3-DCy)

Figure 12:
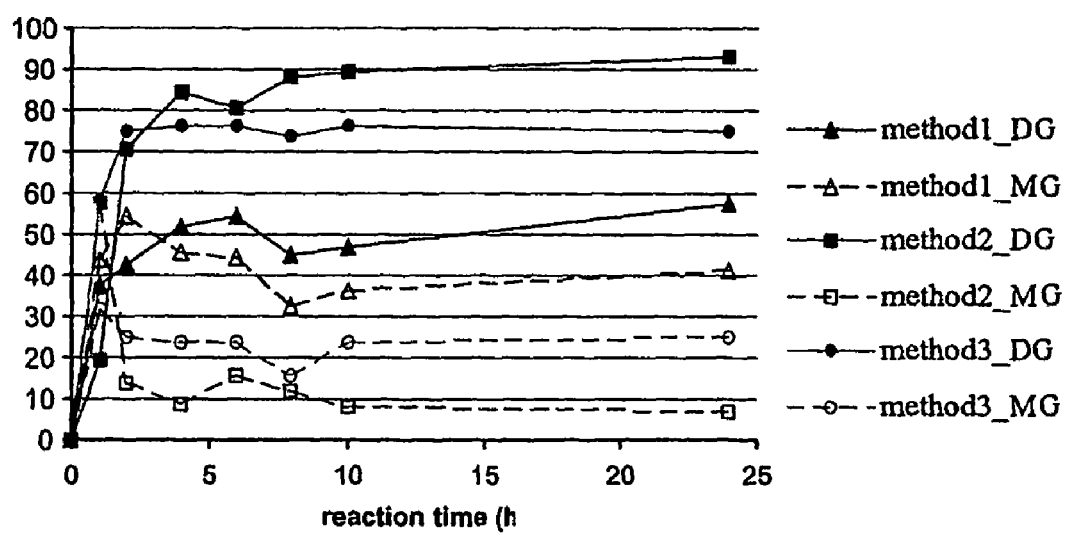
FIG. 12 illustrates data of various esterification reactions in the synthesis of 1,3-DCy, as discussed in Example 7, below.

1,3DCy was purified by crystallization from n-hexane at −20° C. several times. When high amount of MG was presented, the second crystallization in dry methanol has to be done to obtain 1,3-DCy in high purity (>98%). Highest yield of 1,3-DCy (93%) obtained from esterification between vinyl caprylate (CyVE) and glycerol at 0° C. in a solvent-free condition catalyzed by CAL-B. The yield thus obtained was higher than the yield obtained (75%) in literature (see, e.g., J. Am. Oil Chem. Soc., 1992, 69:955-960), see FIG. 12. FIG. 12 illustrates data of various esterification reactions in the synthesis of 1,3-DCy. Method 1 is the esterification of glycerol and caprylic acid in a solvent-free condition at 0° C. catalyzed by CAL-B. Method 2 is the esterification of glycerol and caprylic acid vinyl ester in a solvent-free condition at 0° C. catalyzed by CAL-B. Method 3 see, e.g., J. Am. Oil Chem. Soc., 1992, 69:955-960) is the esterification of glycerol immobilized on silica gel and caprylic acid vinyl ester in MTBE at room temperature catalyzed by Lipozyme RM IM™ (Novozymes, Denmark). DG=1,3-dicaprylin, MG=1-monocaprylin.

Esterification between caprylic acid (Cy) and glycerol gave moderate yield (55%) at lower reaction rates and high amount of MAG was produced during the reaction. The yield could be increased up to 65% by increasing the reaction temperature from 0° C. to room temperature. CAL-B gave higher yield and less MAG and allowed faster reaction rate than Lipozyme RM IM™ (Novozymes, Denmark) in esterification of glycerol and Cy or CyVE, both in organic solvent and a solvent-free condition.

Figure 13:
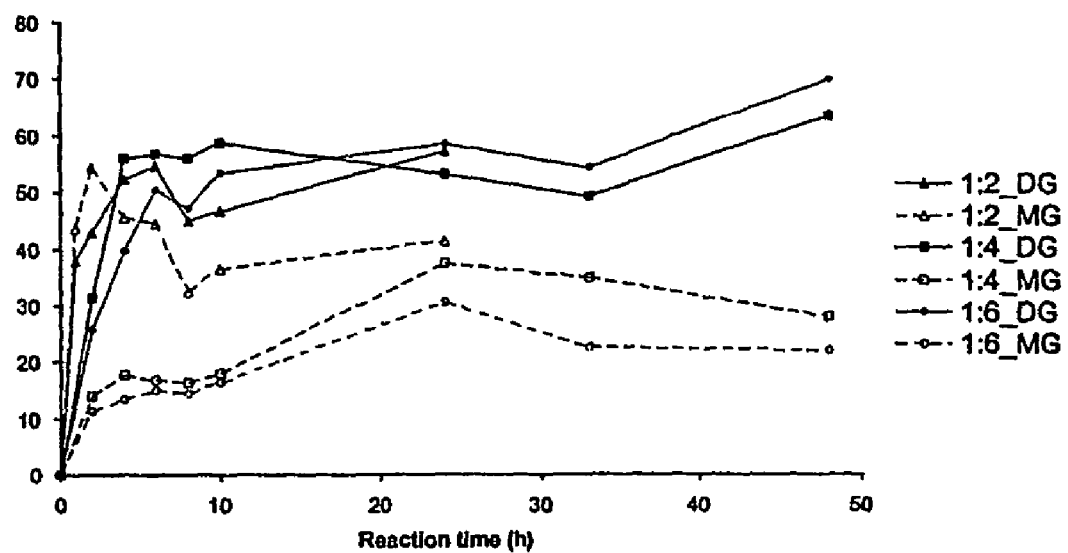
FIG. 13 summarizes data showing the effect of substrate ratio on esterification between glycerol and caprylic acid, as discussed in Example 7, below.

Studies on effect of ratio of glycerol:caprylic acid on esterification reaction showed that initial reaction rate decreased and the yield of 1,3-DCy slightly increased with increasing ratio from 1:2 to 1:6, as illustrated in (FIG. 13). FIG. 13 summarizes data showing the effect of substrate ratio on esterification between glycerol and caprylic acid in n-hexane at 0° C. catalyzed by CAL-B (DG=1,3-dicaprylin, MG=1-monocaprylin).

1,3-Dilaurin (1,3-DLa)

Figure 14:
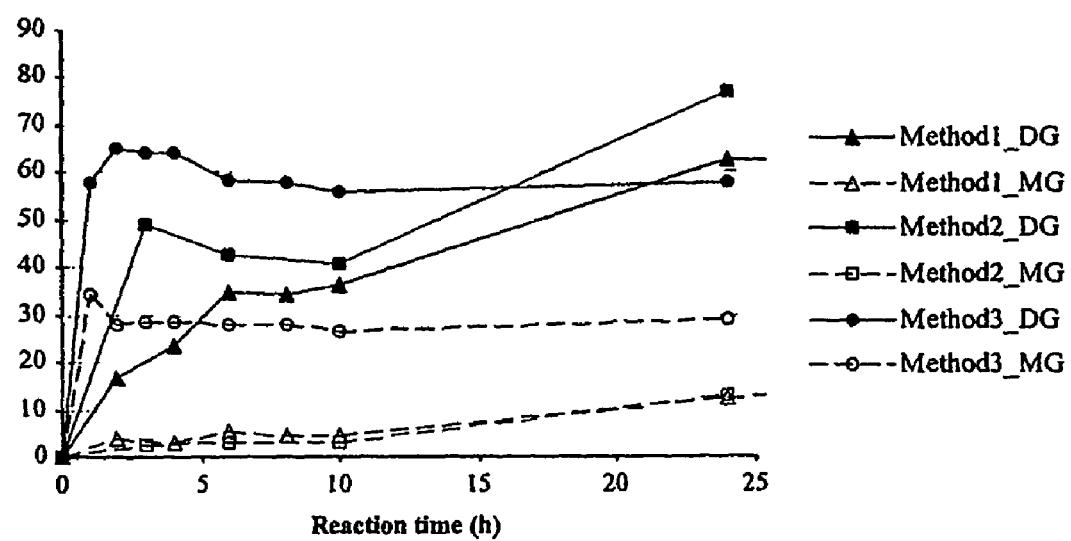
FIG. 14 summarizes data of various synthesis of 1,3-dilaurin, as discussed in Example 7, below.

1,3DLa was easily purified and recovered by crystallization in dry methanol at room temperature (RT) or in hexane at −20° C. (purity>98%). When lauric acid (La) was used as an acyl-donor, solvent was added to dissolve the FFA. Though the method as described in J. Am. Oil Chem. Soc., 1992, 69:955-960,allowed faster reaction rate with high yield of 1,3-DLa (65%), the highest yield (78%) of 1,3-DLa obtained from esterification between glycerol and lauric acid vinyl ester (LaVE) at 0° C. in a solvent-free condition catalyzed by CAL-B after 24 h, as illustrated in FIG. 14. FIG. 14 summarizes data of various synthesis of 1,3-dilaurin. Method1=esterification of glycerol and lauric acid in n-hexane at 0° C. catalyzed by CAL-B; Method2=esterification of glycerol and lauric acid vinyl ester in a solvent-free condition at 0° C. catalyzed by CAL-B; Method3 (Schneider's method) =esterification of glycerol (immobilized on silica gel) and lauric acid vinyl ester in MTBE at room temperature catalyzed by Lipozyme RM IM™ (Eurzyme, Dublin, Ireland). (DG=1,3-dilaurin, MG=1-monolaurin). LaVE, as acyl donor, allowed higher yield and faster reaction with less amount of MG than La.

Figure 15:
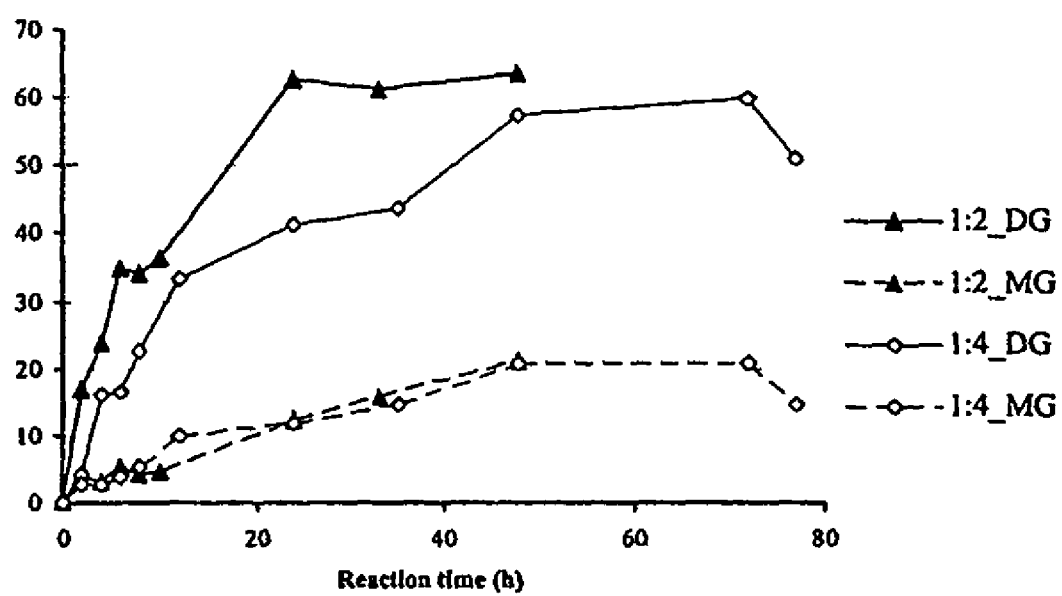
FIG. 15 summarizes the effect of substrate ration on esterification of glycerol and lauric acid in n-hexane, as discussed in Example 7, below.

CAL-B gave highest yield and fastest reaction rate of esterification of LaVE and glycerol at 0° C., while Lipozyme RM IM™ gave moderate yield of 1,3-DLa with high amount of MG and Lipozyme TL™ showed very low activity in the same reaction condition. When increasing reaction temperature to 25° C., Lipozyme RM IM™ showed higher activity, while CAL-B was less active. In the esterification reaction between glycerol and lauric acid in n-hexane catalyzed by CAL-B, reaction rate and the yield of 1,3-DLa decreased with increasing amount of La, as shown in FIG. 15. FIG. 15 summarizes the effect of substrate ration o esterification of glycerol and lauric acid in n-hexane at room temperature catalyzed by CAL-B (DG=1,3-dilaurin, MG=1-monolaurin).

1,3-Dipalmitin (1,3-DP) and 1,3-distearin (1,3-DS)

Figure 16:
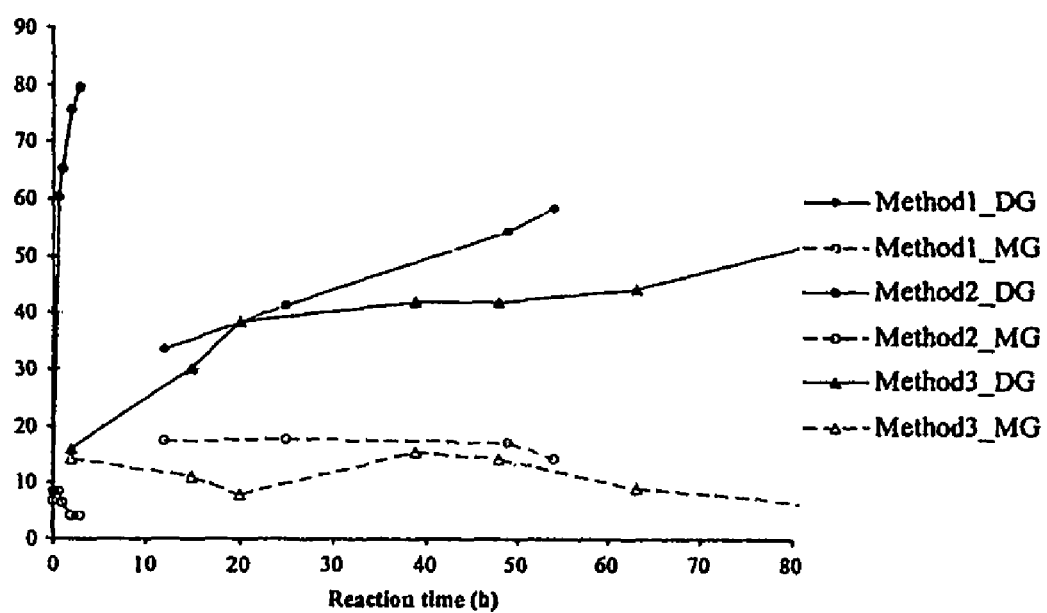
FIG. 16 summarizes the synthesis of 1,3-dipalmitin, as discussed in Example 7, below.

Reactions were carried out in organic solvent and at higher temperature (25° C. to 40° C.) due to a low solubility of palmitic acid (PA) and stearic acid (SA). The DG yield was lower than the yield of the reaction with La or Cy. Highest yield (80%) and fastest reaction rate was obtained from esterification of glycerol and palmitic acid vinyl ester (PAVE) in MTBE at 40° C. catalyzed by D-EP100. Reaction reached the equilibrium within 6-8 h with low amount of MG. Esterification of PA and immobilized glycerol gave higher yield and faster reaction than esterification with free glycerol, as shown in FIG. 16. FIG. 16 summarizes the synthesis of 1,3-dipalmitin. Method1=esterification of glycerol and palmitic acid in MTBE at 40° C. catalyzed by D-EP 100; Method2=esterification of glycerol and palmitic acid vinyl ester in MTBE at 40° C. catalyzed by D-EP100; Method 3 (Schneider's method)=esterification of glycerol (immobilized on silica gel) and palmitic acid vinyl ester in MTBE at room temperature catalyzed by Lipozyme RM IM™. (DG=1, 3-dipalmitin, MG=1-monopalmitin).

Figure 17:
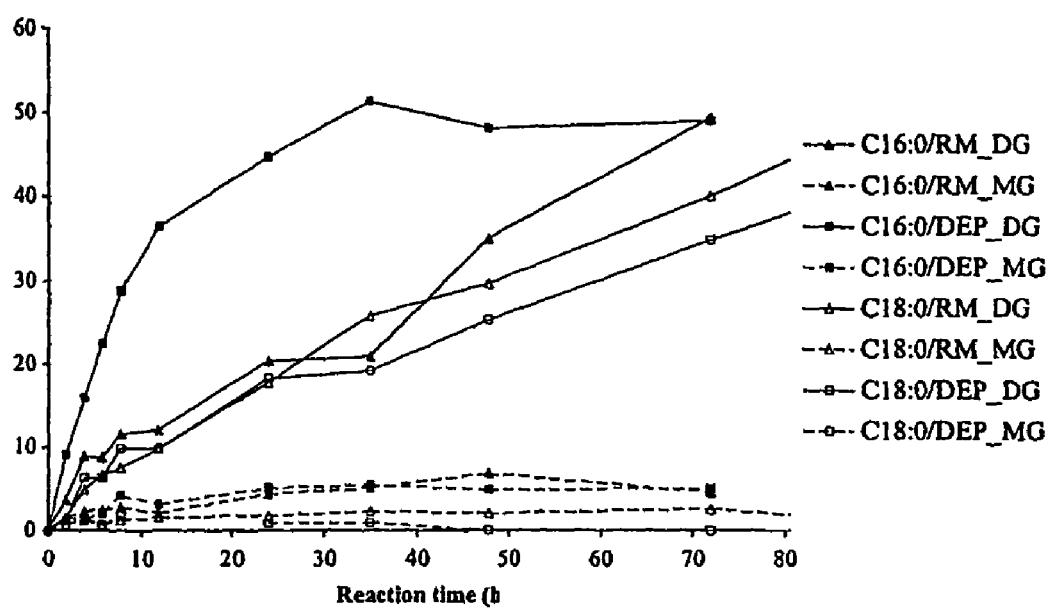
FIG. 17 summarizes data for the esterification of glycerol and palmitic (C16:0) or stearic (C18:0) acid, as discussed in Example 7, below.

D-EP100 gave higher yield and activity than Lipozyme RM IM™ in all cases of 1,3-DP synthesis. Moreover, Lipozyme RM IM™ showed no activity in esterification of PA or PAVE when the reaction was performed in MTBE and low activity in n-hexane. D-EP100 preferred the esterification of PA than SA, while not much different activity on PA and SA was observed with Lipozyme RM IM™, as illustrated in FIG. 17. FIG. 17 summarizes data for the esterification of glycerol and palmitic (C16:O) or stearic (C18:0) acid in n-hexane at 40° C. (RM=Lipozyme RM IM™, DEP=D-EP100, DG=1,3-diglycerides, MG=1-monoglycerides).

Alcoholysis of Triglycerides

Figure 18:
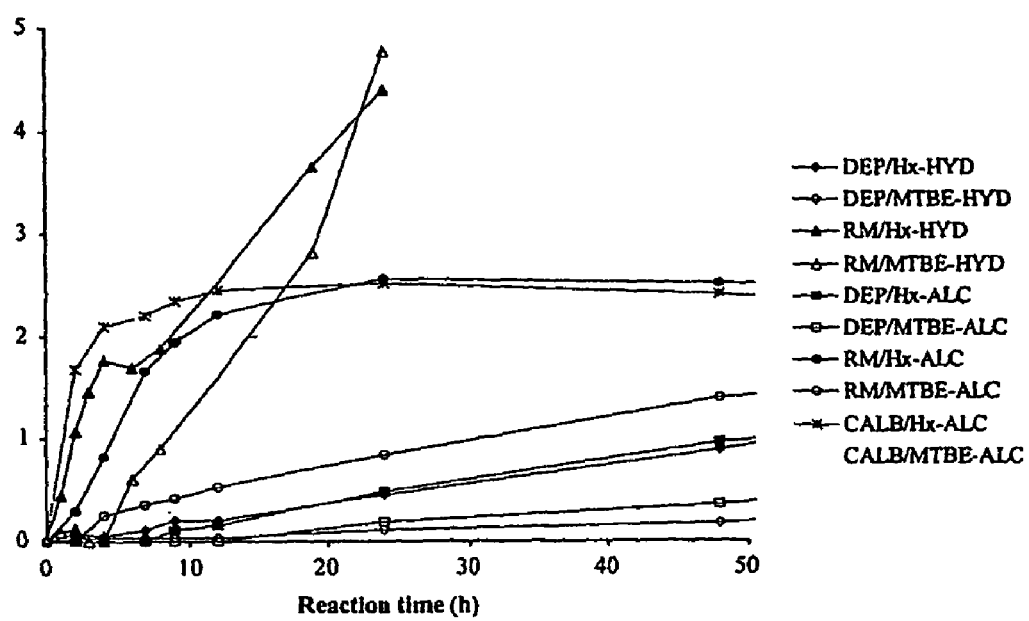
FIG. 18 shows data from alcoholysis reaction, as discussed in Example 7, below.

Alcoholysis of pure triglycerides (TGs), including trilaurin, tripalmitin and tristearin, was carried out. Most diglyceride (DG) obtained from alcoholysis reaction were 1,2-DG. A high amount of unreacted TG remained in the reaction mixture. Acyl migration was observed during the reaction, especially in hydrolysis reaction, as illustrated in FIG. 18. FIG. 18 shows data from alcoholysis reaction showing the 1,3-DS/1, 2-DS ratio during alcoholysis and hydrolysis of tristearin. DEP=D-EP100, RM=Lipozyme RM IM, Hx=n-hexane, HYD=hydrolysis, ALC=alcoholysis.

The reaction catalyzed by Lipozyme RM IM™, though gave lower yield, showed higher acyl migration than the reaction catalyzed by D-EP100. Low acyl migration was observed in alcoholysis using CAL-B after 6 h. This could be because 1,2-DG and 1,3-DG were produced at the same time according to the non-specificity of CAL-B.

Figure 19:
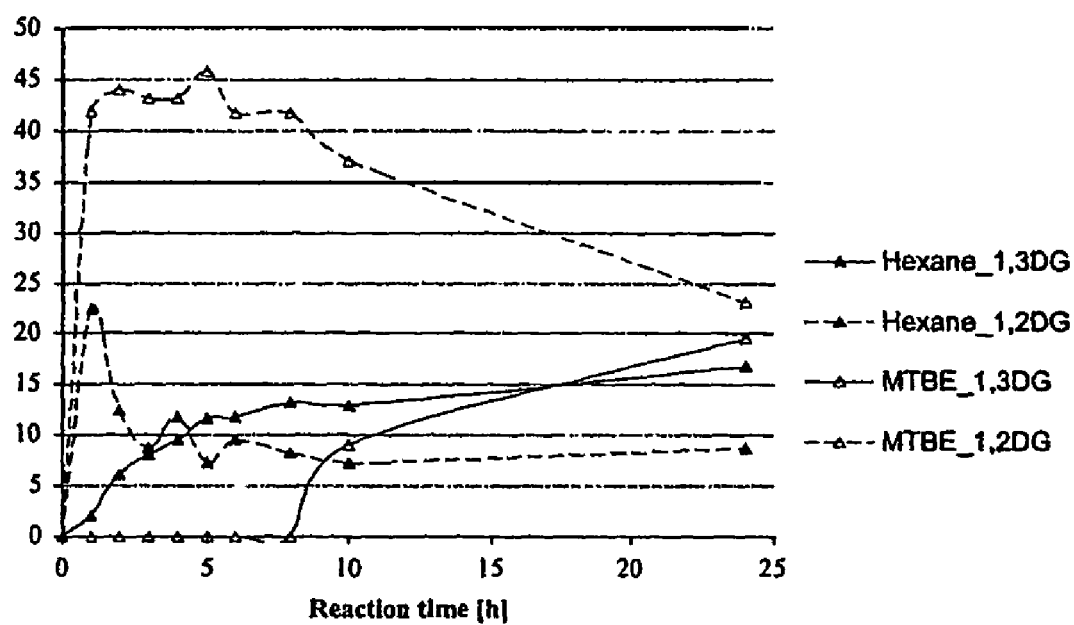
FIG. 19 illustrates data from the hydrolysis of trilaurin, as discussed in Example 7, below.

D-EP100 showed higher activity than CAL-B and Lipozyme RM, respectively, in alcoholysis of tripalmitin and tristearin. Effect of $a_W$: Higher yield and less MG was obtained from alcoholysis at aW 0.11 than 0.43. It was found that MG was increased with increasing $a_W$. Effect of solvents (on yield and acyl migration): Highest yield was obtained with MTBE. Alcoholysis in n-hexane and isooctane gave moderate yield, while acetone was a poor solvent for Lipozyme RM. The reaction performed in n-hexane showed faster acyl migration than in MTBE, as illustrated in FIGS. 18 and 19. FIG. 19 illustrates data from the hydrolysis of trilaurin at 60° C. by Lipozyme RM IM™(DG=dilaurin).

Hydrolysis of Triglycerides

Hydrolysis of pure triglycerides (TGs), including trilaurin, tripalmitin and tristearin, was carried out. A high amount of FFA was produced during the reaction and high amount of unreacted TG remained in the reaction mixture. Most DG was 1,2-DG. Hydrolysis reaction showed higher acyl migration than alcoholysis reaction.

Figure 20:
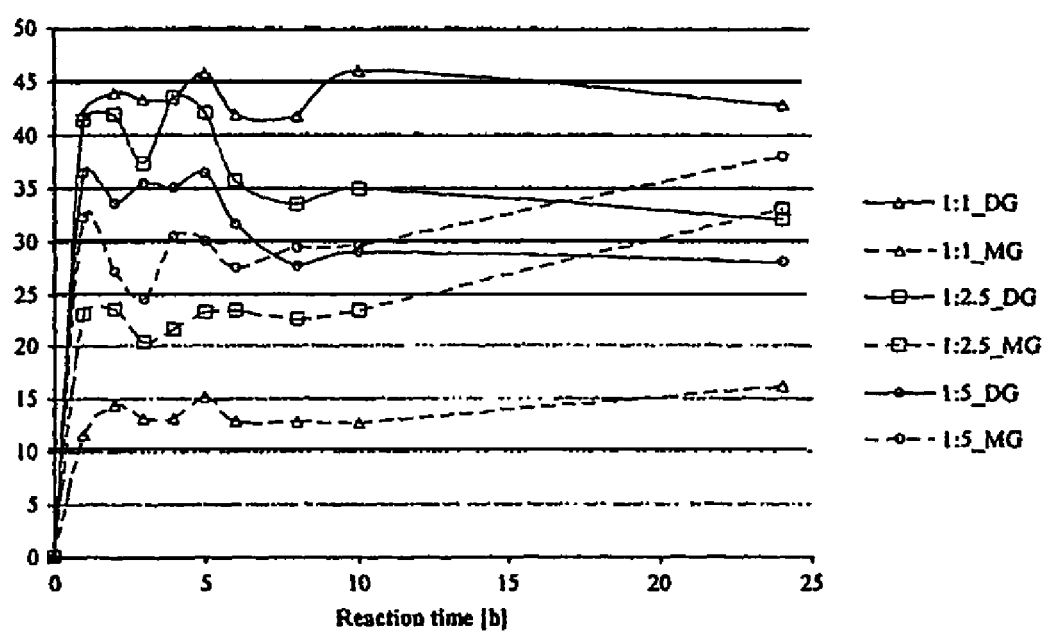
FIG. 20 shows the effect of trilaurin:water ratio on hydrolysis of trilaurin, as discussed in Example 7, below.

Effect of amount of water: highest yield was obtained using TG:water ratio of 1:1, as illustrated in FIG. 20. FIG. 20 shows the effect of trilaurin:water ratio on hydrolysis of trilaurin in MTBE at 60° C. by Lipozyme RM IM™ (DG=1,2-dilaurin+ 1,3-dilaurin, MG=monolaurin). The amount of MG was increased with increasing TG:water ratio, especially in MTBE.

Figure 21:
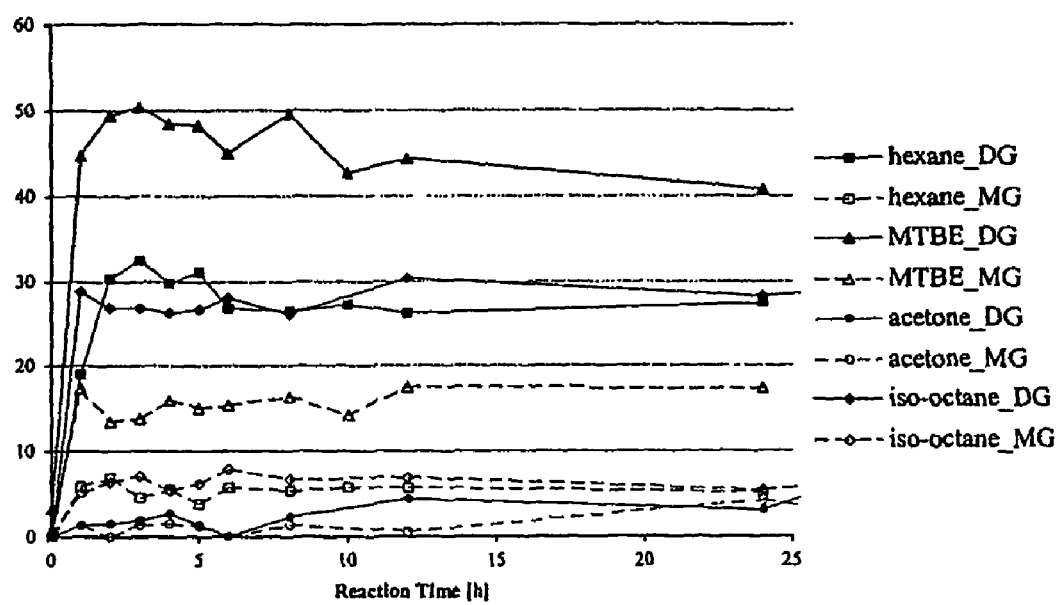
FIG. 21 summarizes data showing the effect of organic solvents on hydrolysis of trilaurin, as discussed in Example 7, below.

Effect of solvents: the result was corresponding to the result obtained from alcoholysis reaction. Hydrolysis in MTBE allowed higher yield than in n-hexane, isooctane and acetone, respectively, as illustrated in FIG. 21. FIG. 21 summarizes data showing the effect of organic solvents on hydrolysis of trilaurin at 60° C. using Lipozyme RM IM™ (DG=1,2-dilaurin+1,3-dilaurin, MG=1-monolaurin+2-monolaurin). Though reaction in MTBE gave higher yield, high amount of FFA was produced and lower acyl migration was found than in n-hexane. The separation of TG, DG, MG and FFA can be a problem.

Alcoholysis and Hydrolysis of Natural Oils

Figure 22:
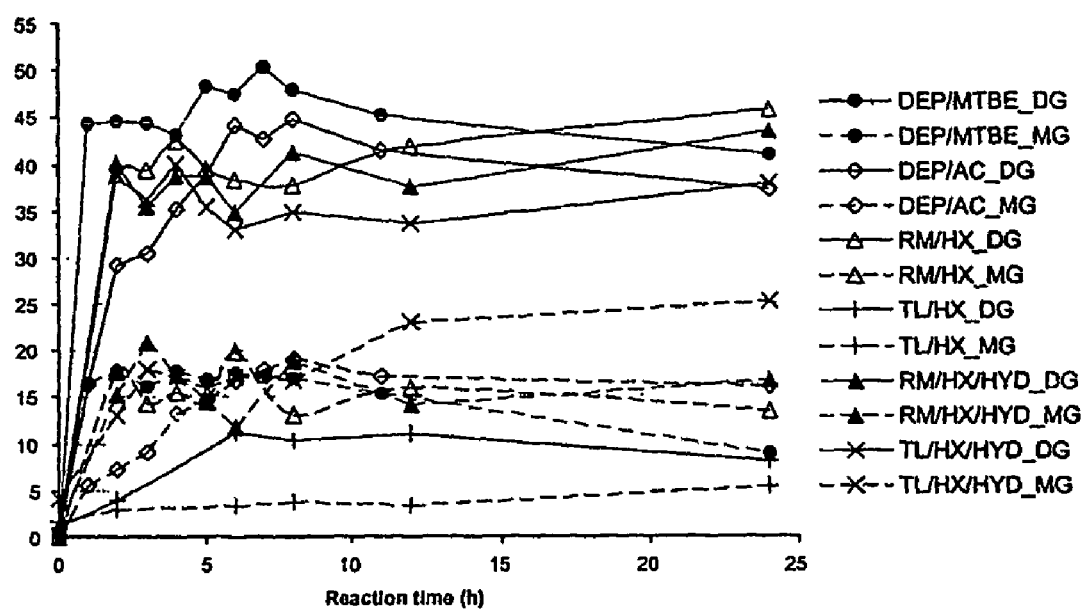
FIG. 22 illustrates data from the alcoholysis and hydrolysis of coconut oil in organic solvent, as discussed in Example 7, below.

Alcoholysis and hydrolysis of natural oils, including coconut and palm kernel oils, was carried out. The 1,3-DG yield of reaction with natural oils was slightly less than the yield of alcoholysis and hydrolysis of pure TG. The highest DG yield (45-50%) and fastest reaction rate was obtained from alcoholysis in MTBE at 40° C. by D-EP100, as illustrated in FIG. 22. FIG. 22 shows the results of alcoholysis and hydrolysis of coconut oil in organic solvent at 40° C. (TG:ethanol=1:1 mol/mol, TG:water=1:2 mol/mol). Lipozyme RM IM™ gave higher yield and less MG than Lipozyme TL™. Reaction performed in MTBE gave higher yield and faster reaction rate than in n-hexane and acetone, respectively.

Induction of Acyl Migration

Figure 23:
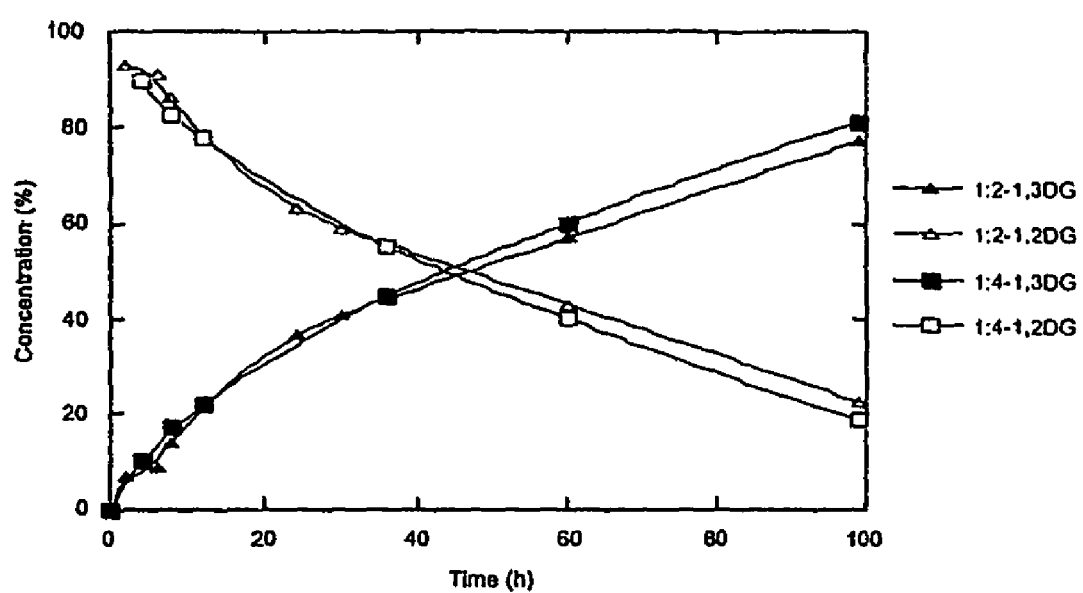
FIG. 23 shows the effect of oleic acid on acyl migration of 1,2-dipalmitin in n-hexane at room temperature, as discussed in Example 7, below.

Acyl migration was carried out on natural oils, including coconut and palm kernel oils. The effect of temperature and carrier was not clear. Almost no acyl migration was observed after 72 h. Addition of oleic acid to the reaction mixture slightly induced acyl migration, as illustrated in FIG. 23. FIG. 23 shows the effect of oleic acid on acyl migration of 1,2-dipalmitin in n-hexane at room temperature. The acyl migration rate was increased with increasing oleic acid:1,2-DP ratio.

Figure 24:
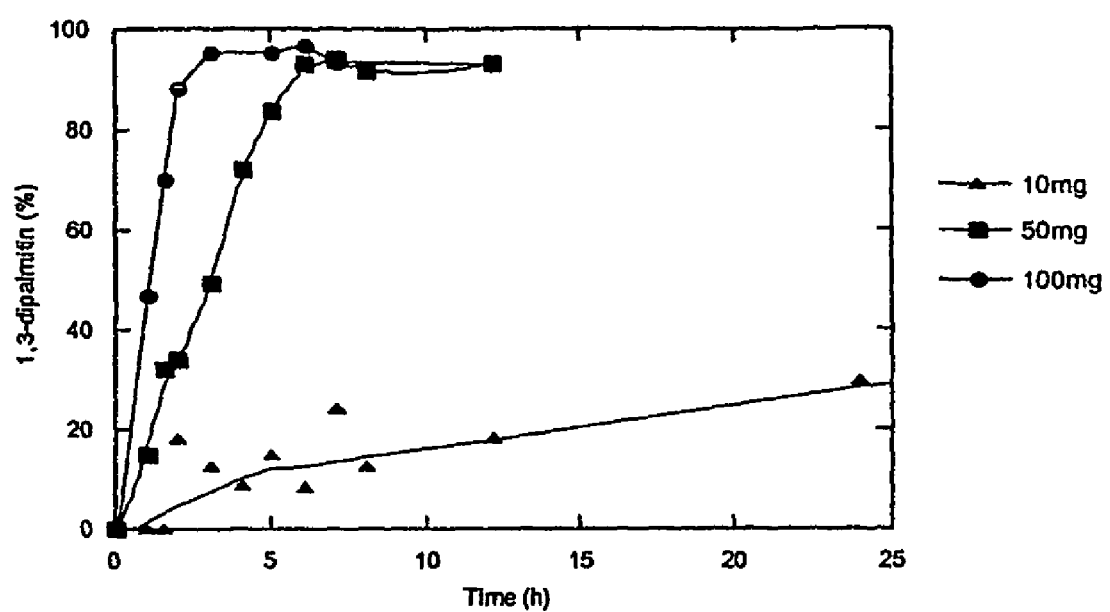
FIG. 24 shows the effect of the amount of anion exchanger on acyl migration of 1,2-dipalmitin in n-hexane, as discussed in Example 7, below.

Anion exchangers showed high induction of acyl migration, while cation exchange showed no effect. The acyl migration rate was increased with increasing amount of anion exchanger, as illustrated in FIG. 24. FIG. 24 shows the effect of the amount of anion exchanger on acyl migration of 1,2-dipalmitin (5 mg/ml) in n-hexane at room temperature. A large amount of anion-exchanger was required to induce a fast acyl migration.

Esterification of 1,3-DG and FFA/FAVE

Esterification of 1,3-DLa and OA in n-hexane was carried out with immobilized lipase from *Pseudomonas* sp. (Amano PS-D), *Candida antarctica* type A (CAL-A), and *Penicillium cyclopium* (Lipase G). Molecular sieve was added to the reaction mixtures to remove the produced water. It was found that only PS-D was capable of catalyzing the esterification reaction of 1,3-DG and oleic acid (OA) or vinyl oleate (OAVE). The reaction was fast. Almost all 1,3-DG was consumed after 2 h for 1,3-DCy and 8 h for 1,3-DLa.

Figure 25:
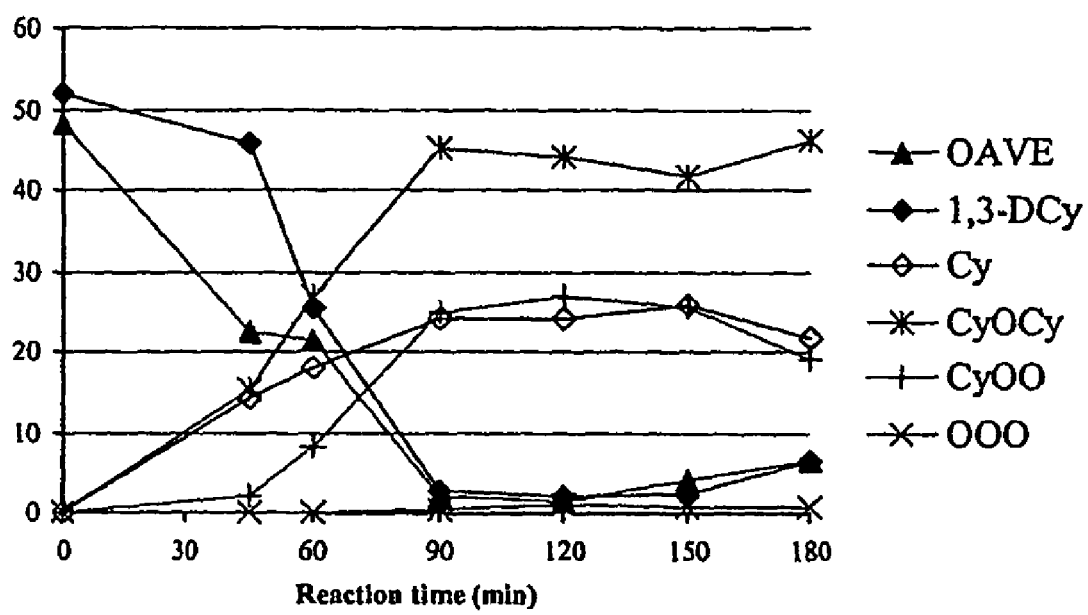
FIG. 25 shows data from the esterification of 1,3-dicaprylin and oleic acid vinyl ester in n-hexane by an immobilized lipase from a *Pseudomonas* sp. (Amano PS-D, Amano Enzyme USA, Elgin, Ill.), as discussed in Example 7, below.

Table 1 shows the fatty acid compositions of the ST products thus obtained. By-products of CyOO and OOO were present due to the non-specificity of PS-D, as illustrated in FIG. 25.

TABLE 1

Fatty acid composition of structured triglycerides products.

| Structured triglycerides | Fatty acids (%)* | | |
|---|---|---|---|
| | C8:0 | C12:0 | C18:1 |
| CyOCy | 61.0 | — | 39.0 |
| LaOLa | — | 63.3 | 36.7 |
| CyOCy (larger scale) | 66.9 | — | 33.1 |

*determined by GC analysis

FIG. 25 shows data from the esterification in larger scale of 1,3-dicaprylin and oleic acid vinyl ester in n-hexane at 60° C. by the immobilized lipase from a *Pseudomonas* sp. (PS-D). Acylglycerol composition was analyzed by HPLC.

Figure 26:
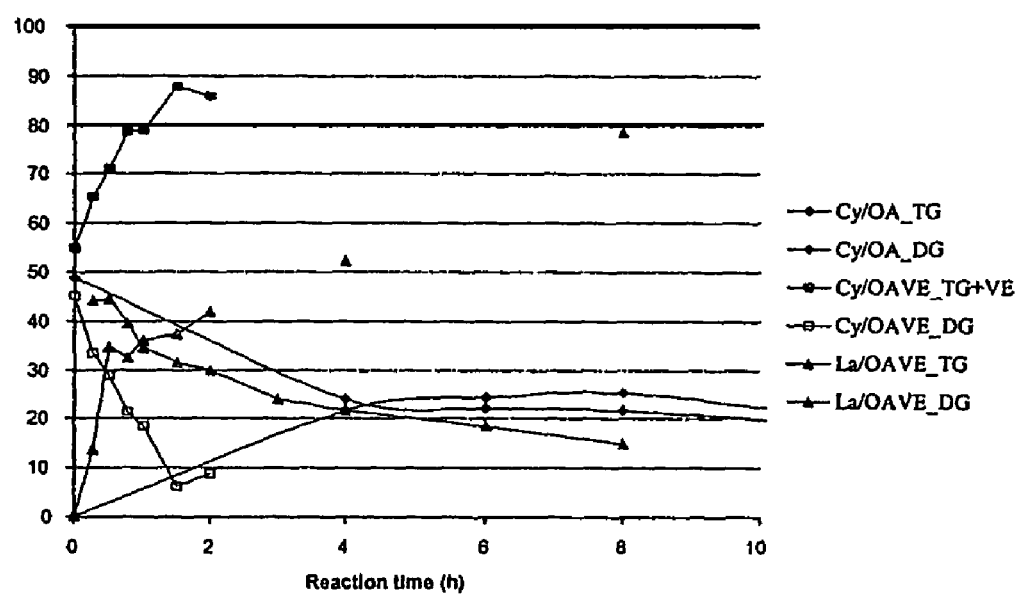
FIG. 26 shows data from the esterification of 1,3-DG and oleic acid or oleic acid vinyl ester in n-hexane by an immobilized lipase from a *Pseudomonas* sp. (Amano PS-D, Amano Enzyme USA, Elgin, Ill.), as discussed in Example 7, below.

Vinyl oleate (OAVE) allowed much faster reaction than OA and 1,3-DCy allowed faster reaction than 1,3-DLa, as illustrated in FIG. 26. FIG. 26 shows data from the esterification of 1,3-DG and oleic acid (C18:1) or oleic acid vinyl ester (OAVE) in n-hexane at 60° C. using PS-D. Acylglycerol composition was determined by TLC/FID (Cy=reaction with 1,3-dicaprylin, La=reaction with 1,3-dilaurin, TG=triglycerides, DG=1,3-diglycerides, VE=vinyl ester).

Example 8

Protease Activity Assays

The following example describes exemplary protease activity assays to determine the catalytic activity of a protease (e.g., an enzyme of the invention). These exemplary assays can be used to determine if a polypeptide (e.g., a protease) is within the scope of the invention.

The activity assays used for proteinases (active on proteins) include zymograms and liquid substrate enzyme assays. Three different types of zymograms were used to measure activity: casein, gelatin and zein. For the liquid substrate enzyme assays, three main types were used: gel electrophoresis, O-pthaldialdehyde (OPA), and fluorescent end point assays. For both the gel electrophoresis and OPA assays, four different substrates were used: zein, Soybean Trypsin Inhibitor (SBTI, SIGMA-Aldrich, T6522), wheat germ lectin and soybean lectin. The substrate for the fluorescent end point assay was gelatin.

The activity assays used for proteinases and peptidases (active on peptides) used pNA linked small peptide substrates. The assays included specificity end point assays, unit definition kinetic assays and pH assays.

The following example describes the above-mentioned exemplary protease activity assays. These exemplary assays can be used to determine if a polypeptide is within the scope of the invention.

Protein (Proteinase Activity)
Casein Zymogram Gel Assays

Casein zymogram gels were used to assess proteinase activity. The protease activity assays were assessed using 4-16% gradient gels (Invitrogen Corp., Carlsbad, Calif.) containing casein conjugated to a blue dye and embedded within the gel matrix. All zymogram gels were processed according to the manufacturer's instructions. Briefly, each sample was mixed with an equal volume of 2× loading dye and incubated without heating for ten minutes before loading. After electrophoresis, gels were incubated in a renaturing buffer to remove the SDS and allow the proteins to regain their native form. Gels were then transferred to a developing solution and incubated at 37° C. for 4 to 24 hours. If a protease digests the casein in the gel, a clear zone is produced against the otherwise blue background that corresponds to the location of the protease in the gel. Negative controls (indicated with NC on gel images) were processed along with the experimental samples in each experiment and electrophoresed on the casein zymograms next to their corresponding protease(s).

Unlike traditional SDS-PAGE, samples are not heat denatured prior to electrophoresis of casein zymograms. As a result, it is sometimes difficult to accurately assess the molecular weight of the proteases. For example, Subtilisin A (Sigma, P5380, indicated with Subt.A on the gel images), which was used as a positive control in these experiments, is predicted to be approximately 27 kDa in size. However, when electrophoresed through casein zymograms using the conditions described, Subtilisin A barely migrates into the gel and is visible only above 183 kDa. Therefore, the zymograms do not define the MW of the proteases indicated, but rather used as an indicator of activity.

Gelatin Zymogram Assays

Gelatin zymograms, Novex® Zymogram Gels, were performed according to manufacturer's instructions (Invitrogen Corp., Carlsbad, Calif.). Unlike the casein zymograms, gelatin zymograms were post-stained following development using either a Colloidal Blue Staining Kit or the SIMPLY-BLUE™ Safestain, (both from Invitrogen). Areas of protease activity appeared as clear bands against a dark background.

Corn Zein Assays

Corn zein was used as substrate for protease activity assays, using powder, Z-3625 (Sigma Chemical Co. St. Louis, Mo.), and Aquazein, 10% solution (Freeman Industries, Tuckahoe, N.Y.). When fractionated through a SDS-PAGE gel, zein from both suppliers produced bands of 24 and 22 kDa. The two zein bands correspond in molecular weight to those previously described for alpha-zein, the most abundant subclass of zeins, which are estimated to comprise 71-84% of total zein in corn (see, e.g., Consoli (2001) Electrophoresis 22:2983-2989).

Lyophilized culture supernatants containing active protease were resuspended, dialyzed, and incubated with zein in 50 mM $KPO_4$, pH 7.5. Reactions were run in a 96-well microtiter format. "Substrate only" and "enzyme preparation only" controls were processed as well as experimental samples. After 24 hours at 30° C., aliquots were removed and subjected to OPA, SDS-PAGE, or Zymogram analysis. In some cases, fresh aliquots were removed and analyzed after 48 or 72 hours at 30° C.

Zein Zymogram: Aquazein was added to a final concentration of 0.075% in a 10% polyacrylamide gel. Aliquots of dialyzed protease samples were electrophoresed through the zein zymogram using standard conditions. Following electrophoresis, the zymogram gel was washed, incubated in a renaturing buffer, incubated overnight in a developing buffer optimized for protease activity (contains NaCl, $CaCl_2$, and Brij 35, in Tris buffer pH 8), and stained with Coomassie blue stain.

SDS-PAGE: Aliquots of equal volume were removed from each sample and subjected to SDS-PAGE analysis. Following electrophoresis, proteins in the gels were stained with SYPRO Orange (Molecular Probes) and visualized using UV transillumination.

OPA: In the presence of Beta-mercaptoethanol (BME), OPA reacts with free amino ends to produce a fluorescent imidazole that can be detected using a standard fluorescence plate reader. In this assay, aliquots of equal volume were removed from each sample and placed in a black fluorescence plate. Samples were then diluted 1:10 in OPA reagents. Fluorescence (Ex=340 nm, Em=450 nm) was determined after a 5-minute incubation.

Soybean Trypsin Inhibitor Assays

Soybean Trypsin Inhibitor (SBTI, SIGMA-Aldrich, T6522) was used as a substrate for protease activity. Lyophilized culture supernatants containing active protease were resuspended, dialyzed, and incubated with SBTI (1 mg/ml final conc.) at 37° C. in 50 mM $KPO_4$, pH 7.5. Substrate alone and enzyme preparation alone controls were processed along with experimental samples. After 24 hours, aliquots were removed and subjected to OPA and SDS-PAGE analysis. SDS-PAGE: for SBTI, following electrophoresis, proteins in the gels were stained with Coomassie blue.

Wheat Germ Lectin Assays

Wheat germ lectin (WGA, EY Laboratories, L-2101, Pure) was used as a substrate for protease activity. Lyophilized culture supernatants containing active protease were resuspended, dialyzed, and incubated with WGA (1 mg/ml final concentration) at 37° C. in 50 mM $KPO_4$, pH 7.5. Substrate alone and enzyme preparation alone controls were processed along with experimental samples. After 24 hours, aliquots were removed and subjected to OPA and SDS-PAGE analysis as. SDS-PAGE: for WGA, following electrophoresis, proteins in the gels were stained with Coomassie blue.

Soybean lectin assays Soybean lectin (SBA, EY Laboratories, L-1300, Crude) was used as a substrate for protease activity. Lyophilized culture supernatants containing active protease were resuspended, dialyzed, and incubated with SBA (1 mg/ml final concentration) at 37° C. in 50 mM $KPO_4$, pH 7.5. Substrate alone and enzyme preparation alone controls were processed along with experimental samples. After 24 hours, aliquots were removed and subjected to OPA and SDS-PAGE analysis. SDS-PAGE: for SBA, following electrophoresis, proteins in the gels were stained with Coomassie blue.

Gelatin in Fluorescent Liquid End Point Assay

DQ Gelatin (Molecular Probes, fluorescein conjugate, D-12054) was used to assess the proteolytic activity of the proteases of the invention. DQ gelatin is a protein that is so heavily labeled with a fluorophore that its fluorescence is quenched when the molecule is intact. Proteases that cleave the substrate will release the fluorophores from internal quenching and fluorescence will increase in proportion to the protease activity. DQ Gelatin was diluted to a final concentration of 25 ug/ml in 100 ul reactions containing a suitable buffer such as zymogram developing buffer (Invitrogen) and varying amounts of protease preparations. Reactions were incubated in a 384 well, clear, flat-bottom microtiter plate at 37° C. for various time periods from 1 hr to overnight. Fluorescence was monitored using a fluorescence plate reader after incubation at 37° C. for various times.

Example 9

Simulation of PLC-Mediated Degumming

This example describes an exemplary use of a hydrolase of the invention, a phospholipase of the invention, comprising the simulation of phospholipase C (PLC)-mediated degumming.

Due to its poor solubility in water phosphatidylcholine (PC) was originally dissolved in ethanol (100 mg/ml). For initial testing, a stock solution of PC in 50 mM 3-morpholinopropanesulpholic acid or 60 mM citric acid/NaOH at pH 6 was prepared. The PC stock solution (10 µl, 1 µg/µl) was added to 500 µl of refined soybean oil (2% water) in an Eppendorf tube. To generate an emulsion the content of the tube was mixed for 3 min by vortexing. The oil and the water phase were separated by centrifugation for 1 min at 13,000 rpm. The reaction tubes were pre-incubated at the desired temperature (37° C., 50° C., or 60° C.) and 3 µl of PLC from *Bacillus cereus* (0.9 U/µl) were added to the water phase. The disappearance of PC was analyzed by TLC using chloroform/methanol/water (65:25:4) as a solvent system (see, e.g., Taguchi (1975) supra) and was visualized after exposure to $I_2$ vapor. The oil and water phases are separated after centrifugation and PLC is added to the water phase, which contains the precipitated phosphatides ("gums"). The PLC hydrolysis takes place in the water phase. The time course of the reaction is monitored by withdrawing aliquots from the water phase and analyzing them by TLC.

Example 10

Expression of Hydrolases (e.g. Phospholipases) of the Invention

This example describes the construction of a commercial production strain of the invention that can express multiple hydrolases of the invention, e.g., phospholipase enzymes of the invention. In order to produce a multi-enzyme formulation suitable for use in the degumming of food-grade vegetable oils (including soybean, canola, and sunflower), a recombinant expression strain can be generated that expresses two different hydrolases of the invention, e.g., phospholipase enzymes of the invention, in the same expression host. For example, this strain may be constructed to contain one or more copies of a hydrolase (e.g., a PLC) gene and one or more copies of another hydrolase gene (e.g., a phosphatidylinositol-PLC gene). These genes may exist on one plasmid, multiple plasmids, or the genes may be inserted into the genome of the expression host by homologous recombination. When the genes are introduced by homologous recombination, the genes may be introduced into a single site in the host genome as a DNA expression cassette that contains one or more copies of both genes. Alternatively, one or more copies of each gene may be introduced into distinct sites in the host chromosome. The expression of these two gene sequences could be driven by one type of promoter or each gene sequence may be driven by an independent promoter. Depending on the number of copies of each gene and the type of promoter, the final strain will express varying ratios of each active enzyme type. The expression strains can be constructed using any *Streptomyces* or *Bacillus*, *Bacillus cereus*, *E. coli*, *S. pombe*, *P. pastoris*, or other gram-negative, gram-positive, or yeast expression systems.

Figure 31:
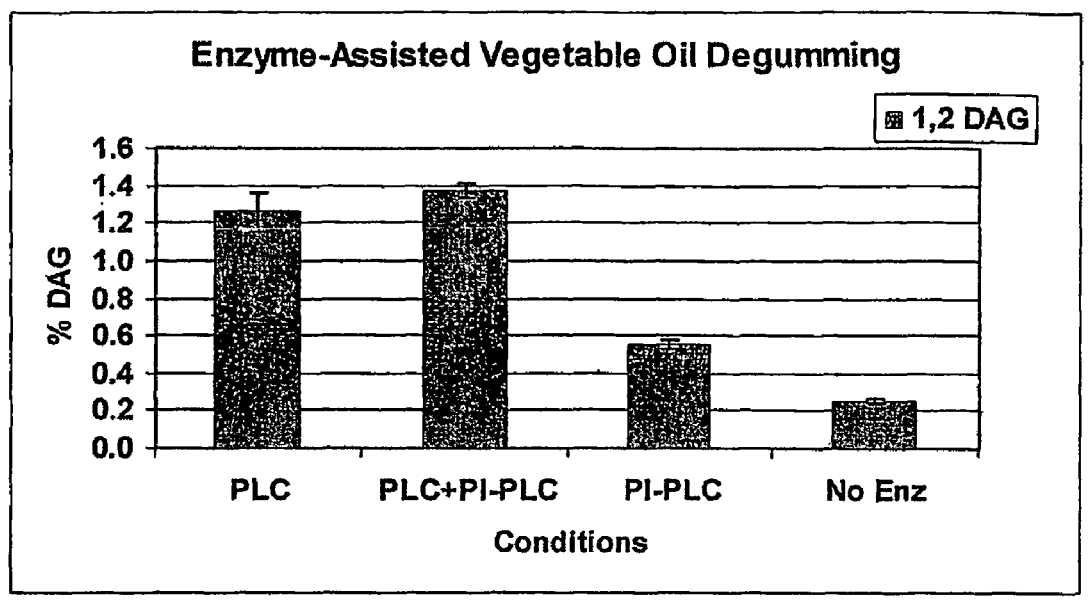
FIG. 31 schematically illustrates data from a two enzyme system of the invention, as described in Example 10, below.

In one aspect, the invention provides a two-enzyme system for degumming of soybean oil, wherein at least one enzyme is a hydrolase enzyme of the invention. PLC plus PI-PLC produces more DAG than either enzyme alone. However both enzymes produce more DAG than a no enzyme control sample. In one aspect, reaction conditions comprise 1 milliliter soybean oil, ~0.4% initial moisture, 50° C., 0.2% Citric acid neutralized with 2.75M NaOH, 10U PLC, 15 µL PI-PLC (0.45 mg total protein), 1 hour total reaction time. FIG. 31 illustrates a table summarizing data from this two-enzyme degumming system of the invention.

In another aspect, a PI-PLC enzyme of the invention can be used under the same conditions described for PLC. These include chemical refining of vegetable oils and water degumming of vegetable oils.

A number of embodiments of the invention have been described. Nevertheless, it will be understood that various modifications may be made without departing from the spirit and scope of the invention. Accordingly, other embodiments are within the scope of the following claims.

SEQUENCE LISTING (984 sequences)

SEQ ID NO: 1 - DNA, 924 bp, Unknown
  Obtained from an environmental sample.
atgctggcgcatcctgaggcgggagctcaacccgtcagcttgggaggtgttcttgcgcgaggtgagtctacgcagttgcgtgatgcgcgctgggaggcccaaaccggtgcgcagggcttatggcggccaatggactttctcacacagggcaaggccggcatttattttctcgagccttatgatgcgagacgtattcctgtcttattggtgcacggcataaacggcacccccggcaattttgccgcgatggcggatcatcttgataaaaagcgctttcaactatgggcggcagcctatccgtcaggtttggccatagagggttcagcccggatactgagtcgtttgctgcaagagctgcaagtgcgttatcgcttcaagcagatgattgtggtggcccacagtatgggtggactggtgaccagatccatgctgctggatctggccgcatcgggatcatcgatcaaagtgcggcaagtgtttaccctggcaacaccatggacaggcgatgatcgtgccgccatgggggtacggcatgcgccggcggtgatcagaagctggcgggacatggcttccggcagcgacttcctgcagggcctgtttcacttgccatccggcgcggagcgatcatggcccgccggcgcccggcactatctcttgtttgcctacgaccgggcggacagttggtcggcggagtccagcgactccgtcatcccgctgcgcagtcagttgggtgaagcagcgcaacgtcaggcttatcagctgcgtggatacaatgccacacatgtgggcattctcaacgacgcagctgtctggcgcgatctgaatggctggatggcggagacgccggccgaggccgctcaacctaccagcttgcggcggaatacccagttccgctcatccgaggctgtcggttcaaagcgataa

SEQ ID NO: 2 - protein, 307 aa, Unknown
  Obtained from an environmental sample.
MLAHPEAGAQPVSLGGVLARGESTQLRDARWEAQTGAQGLWRPMDFLTQGKAGIYFLEPYDARRIPVLLVHGINGTPGNFAAMADHLDKKRFQLWAAAYPSGLAIEGSARILSRLLQELQVRYRFKQMIVVAHSMGGLVTRSMLLDLAASGSSIKVRQVFTLATPWTGDDRAAMGVRHAPAVIRSWRDMASGSDFLQGLFHLPSGAERSWPAGARHYLLFAYDRADSWSAESSDSVIPLRSQLGEAAQRQAYQLRGYNATHVGILNDAAVWRDLNGWMAETPAEAAQPTSLRRNTQFRSSEAVGSKR

SEQ ID NO: 3 - DNA, 942 bp, Unknown
  Obtained from an environmental sample.
ttgaaaagattactcatttatattgctctttcgcttctgtcattgtcgtcatgggcaggaaatatcacacaaacgaacgtaaatagcatagggtatacgcaaacgaagtacccaattgtacttgttcacggcttgtttggtttcgatacgttagccggtgttgactatttttatggcatacctcaatcactaacgcaaagtggtgccaaagtctatgtggcacaagtgtcggcggcgaacagcaccgagctaagaggggagcagttactggtacaagtggaaaatgtactggctgtgacaggtgcagaaaaagtgaacctcattggtcatagtcatggaggcccgaccgcaaggtatgttgcctctgttgctccacagttagtggcatcggtcaccagcattggcggtgtgaataagggctcggcagtggctgatcttgcgcgtggtacagttccggaaggttcgatttctgaagcaatcgcggtgaaactagcagaggggctaaccttattgattggcttactttctggtggaatggatcttgagcaagacgtgttagcctctcttgatgcattaaccacagagggagcactcaactttaatacccattatcctgaaggagtaccgacaacggcctgcggagacggtgaatggcaagtaaatggtgtgcactattactcatggacaggaacgtcaacctttaccaatctgctcgatccgattgacggtgctatggtgctattggggttggcttttgatgagccgaacgatggtttagttggccaatgcagcactcatttgggcaaggttattcgagacgattataaaatgaatcatctggatgaaataaatggcatgttaggtattcaccatttatttgaaacggatccggtgacgttatatcgacaacatgccaatcgattgaaactacaaggcttataa

SEQ ID NO: 4 - protein, 313 aa, Unknown
  Obtained from an environmental sample.
MKRLLIYIALSLLSLSSWAGNITQTNVNSIGYTQTKYPIVLVHGLFGFDTLAGVDYFYGIPQSLTQSGAKVYVAQVSAANSTELRGEQLLVQVENVLAVTGAEKVNLIGHSHGGPTARYVASVAPQLVASVTSIGGVNKGSAVADLARGTVPEGSISEAIAVKLAEGLTLLIGLLSGGMDLEQDVLASLDALTTEGALNFNTHYPEGVPTTACGDGEWQVNGVHYYSWTGTSTFTNLLDPIDGAMVLLGLAFDEPNDGLVGQCSTHLGKVIRDDYKMNHLDEINGMLGIHHLFETDPVTLYRQHANRLKLQGL

SEQ ID NO: 5 - DNA, 957 bp, Unknown
  Obtained from an environmental sample.
atgagcattctcacggagtttcccgagccgctgtatctcggccaacagccgcacttccagggcgtcaacgccaacttcgacgtcgatacggcacgcgccatggcgtgggccgcccagctggcgtacgagaccaatgaccaggcgaaggtcggacgcattctggcggcctggcactggacattgcggggatttcacgccggaagggtcagcagcttcctgcctctgaccagcgcgaaagggctcatcgcggcgcgcgatggcgtcagtatcctgacattcgcggggacagagccgaccgctctggccgactggatcgtcgacttttcaattcatcagaccgccgacggcacccatgagggctttgaacaaggcgtcgactccgtctgggacgacatttcagccatcctgggcgccggcggctcctcggcaacggacaagctcttcatcacaggccacagtcttggcggcgcactcgccgccgtggccgcgcgacgcctggtgaaaagcaacgtcgtcggcctggatcgcattctcggcgtttacacgttcggaatgccgcgcagcggtaacgacctgttcgcccaggactatcgggcgatcggtggtggcgctttggcaaaccgtaccttccgttttgtcgacggcgacgacatcgtcccgcaggttccgccgccggaggcccccttcgactatcgacacgtcggctgctcgctcacctgcgggcatggggcgctgttcgacccgggaaacctcgttgccgatgcccccgagccggtggccgccggagcatccgccgtgctgggcctggcgcagggtcttttccgagcgccgccccttcaggaacacctgccggcatttccgggcgatccgctggctgccatcgtcatcgacaatcttcgcccgccgatccgtgaccacctcatggaccgatacctgcgcgcgctcgcggctctctag

SEQ ID NO: 6 - protein, 318 aa, Unknown
  Obtained from an environmental sample.
MSILTEFPEPLYLGQQPHFQGVNANFDVDTARAMAWAAQLAYETNDQAKVGRILAAWHWTLRGFHAGRVSSFLPLTSAKGLIAARDGVSILTFAGTEPTALADWIVDFSIHQTADGTHEGFEQGVDSVWDDISAILGAGGSSATDKLFITGHSLGGALAAVAARRLVKSNVVGLDRILGVYTFGMPRSGNDLFAQDYRAIGGGALANRTFRFVDGDDIVPQVPPPEAPFDYRHVGCSLTCGHGALFDPGNLVADAPEPVAAGASAVLGLAQGLFRAPPLQEHLPAFPGDPLAAIVIDNLRPPIRDHLMDRYLRALAAL

SEQ ID NO: 7 - DNA, 1245 bp, Unknown
  Obtained from an environmental sample.
atgcaacgcgtttttgcaacgcttacggccgctctttcgctggccacgcttcttgcagcatgcgtactacccgcaactcccgctgaagcagccaataccgaccccatcgttctcgtgcacggcttcgccggcttcggccgcgacgaagcgctgggctacaagtactggggcgggttcgacgacctggaggcgtatctcaacagccagggccgcaccacgaagaccgcggtagtgggtccggtcagctccaactgggaccgcgccgtcgagttgtactaccagatcaagggcgggtgtgtggactacggcgccaatcacgccagccacttcggtcacgaccgcaccgtgccgggcaaatgctttcccggtctgtatccgcaatgggatgccgcgcacccggtgcacttggtgacgcacagcatgggcggacagaccgccaagatgctcgtgcagttgctcgaagccaacggtgcgccgcatgagaccggattgttcggcggcgccaagcacggctgggtgaagagcgtgacggcgatttcctcgccgctcaacggcaccacgctcgcggacgtggtgggcaacgacattccgttcgtgatcgacctggtgggcggcatttcggcgctgaccggtctcagcgaccagaacaacttcgtctacaacttcaagctcgagcagtgggacttgaaacgctacccgggagaaggcttcatcagctatcgcaaccgcgtggtggattccccgatctgggagcacccggttgcccgcaaggacttgagcatctggggcctctctcccgacggcgcggcggaggaaaacgcctgggtgcagacgtggtccaacgtttactacttctccttcgccacgaactccacgtttaccggcatcttcaccggctgggaatatccgactcccaccaccaacccgctcatcgtgccgttcgcttatcccgccgcgtggccgttgaagccgggcatgggcaactacaccaataacacgccgggcgaagtggcgatcgacaagtcctggtggcccaacgacgcggtagtgaacaccaagagcatgaaggcgccatggaacgcgtcgagcgtggcggtgaactggaacggcactgcgcagcgcggcaagtggaactacatgggcctgtcggatggcttcgatcacttcgacatcatcggctggacgctcttctgggacgcgcggtcgttttaccagacgcatgccgaccgtctgcgtgcgctgtga

SEQ ID NO: 8 - protein, 414 aa, Unknown
  Obtained from an environmental sample.
MQRVFATLTAALSLATLLAACVLPATPAEAANTDPIVLVHGFAGFGRDEALGYKYWGGFDDLEAYLNSQGRTTKTAVVGPVSSNWDRAVELYYQIKGGCVDYGANHASHFGHDRTVPGKCFPGLYPQWDAAHPVHLVTHSMGGQTAKMLVQLLEANGAPHETGLFGGAKHGWVKSVTAISSPLNGTTLADVVGNDIPFVIDLVGGISALTGLSDQNNFVYNFKLEQWDLKRYPGEGFISYRNRVVDSPIWEHPVARKDLSIWGLSPDGAAEENAWVQTWSNVYYFSFATNSTFTGIFTGWEYPTPTTNPLIVPFAYPAAWPLKPGMGNYTNNTPGEVAIDKSWWPNDAVVNTKSMKAPWNASSVAVNWNGTAQRGKWNYMGLSDGFDHFDIIGWTLFWDARSFYQTHADRLRAL

SEQ ID NO: 9 - DNA, 705 bp, Unknown
  Obtained from an environmental sample.
atgttcaagaaagcccttccggccgctgccgcggtcgctggtctgctcatttcctcgtcggcgctggccctgctgcccgacactcccggcactgccttcccgtcggtgagcaacttcgccaactccggcccctacagcaccaccagccgcagcgaaggccccaactgccggatctaccgtccgagcaccctgggccagaacggcgtccgtcacccggtcatcctctggggcaacggcaccggcgcctcgccgaccacctacggttcgctgctcagccactgggcgagccatggcttcgtggtcgccgcggcggaaacctccaacgccggttccggccaggaaatgctcgcctgcctgagctacctgcagaccgaggccggtcgcagcagcggcacctacgtcggcaagctgaacctgggccgcgtcggcacctccgggcactcccaaggcggcggcggttcgatcatggccggtcgcgacaaccgcatcctgaccaccgcgccgatgcagccgtacatcctcggcctgggccacgacacctcgtcgcagagccagcagaacggcccgatgttcctgatgtccggcgccagcgacaccctggccggtccgaccctgaaccaggcgccggtctatcgccgcgtcaaccagccggtcttctggggcaccctgcgcggcgccagccacttcgagccggtcggcaacgcc

SEQ ID NO: 10 - protein, 235 aa, Unknown
  Obtained from an environmental sample.
MFKKALPAAAAVAGLLISSSALALLPDTPGTAFPSVSNFANSGPYSTTSRSEGPNCRIYRPSTLGQNGVRHPVILWGNGTGASPTTYGSLLSHWASHGFVVAAAETSNAGSGQEMLACLSYLQTEAGRSSGTYVGKLNLGRVGTSGHSQGGGGSIMAGRDNRILTTAPMQPYILGLGHDTSSQSQQNGPMFLMSGASDTLAGPTLNQAPVYRRVNQPVFWGTLRGASHFEPVGNA

SEQ ID NO: 11 - DNA, 849 bp, Unknown
  Obtained from an environmental sample.
atgttcaacaaagcacttcctgcagcggccgcggtcgccggtctgttcctttccacctcggccatggcgctgctgccggatacgcccggaacccccttcccgtcggtgtccagcttcgaaaggtccggtccctacagcaccaccagccgcagcgaaggccccaactgccggatctatcgaccgagcaacctgggccagaacggcgtccgccacccggtcatcctctggggcaacggcaccggtgccagcccgaccacctaccgcggcctgctcgagcactgggccagccacggcttcgtggtcgccgccgccgagacctccaacgccggctccgggcgcgagatgctcaactgcctgagctacctgcagaccgaagccgggcgcagcagcggcacctacgtcggccggctcaatctcggccgcgtcggcacgtccggccactcgcagggcggtggcggctcgatcatggccgggcgcgacacccggatcaaaaccaccgcgcccatgcagccctacaccctgggcctgggccatgtgagttcctcgcagagccagcagaacggcccgatgttcctgatgtccggcagcctggacaccctggccggcccgaccctgaaccaggcgccggtctatcgccgggccaacgtgccggtgttctggggcaccctgcgcggcgccagccacttcgtgccggtcggcagtgccggcggttaccgtggcccgtccaccgcctggttccgctaccagctgatggacgatacctcggcgcgcagccagttcgtcggcaccaactgcggcctgtgccgcgacttctcctggaccgacatccagcgcaagggcgcgctgtaa

SEQ ID NO: 12 - protein, 282 aa, Unknown
  Obtained from an environmental sample.
MFNKALPAAAAVAGLFLSTSAMALLPDTPGTPFPSVSSFERSGPYSTTSRSEGPNCRIYRPSNLGQNGVRHPVILWGNGTGASPTTYRGLLEHWASHGFVVAAAETSNAGSGREMLNCLSYLQTEAGRSSGTYVGRLNLGRVGTSGHSQGGGGSIMAGRDTRIKTTAPMQPYTLGLGHVSSSQSQQNGPMFLMSGSLDTLAGPTLNQAPVYRRANVPVFWGTLRGASHFVPVGSAGGYRGPSTAWFRYQLMDDTSARSQFVGTNCGLCRDFSWTDIQRKGAL

SEQ ID NO: 13 - DNA, 1689 bp, Unknown
  Obtained from an environmental sample.
atgggattgttcgattacaagaatgccgatggcaaagcgttgtacagcgacgccatcgcactgacgctgtatgcctacacgcccaccggccagccattgccggcaaccgcctgggcaccggtcgctgcgaccgcgctgggttatcaaggcaaggtcgggccgcaaggcacgttcttcggcgagaaggacggtttcaccagcgccgaagccgaagtgctcggcaaatacgacgctgcaggcaagttgatcggcatcggcatcgcgtttcgtggcaccggcggcctgggctacagcgacaccttcggtgacctgaaaaacaatctgctggcggccatcggcccatcggattacgcgagcaattacgcgaaaaacgccttcgacaacctgctcaaggcggtcgccgcattcgcgattgccaatggcattgctgccaaggatgtactgatcagcggccacagcctcggcgggctcggggtcaacagcgtcgccgaactgagcgcgggcaactggggcgggttcttcaaagacgccaactatgttgcgttcgcctcgccgacccagagcagcaccggcaacaacgtgttgaacatcggttacgagaacgatccggtgttccgcgtgctcgatggcaccaccttcagcaccgcctcgatgggcaagcacgacaagccccacgaatcgaccaccgataacatcgtcaacttcaacgaaaactacgcctccaccgcgcagaacctcgtgccgttcagcatcatcaatcccatgagctggtcggcccatagttcgctgggttatgccgatggcctgaaccgggtgatcgattcgaagttctacaacctcaccagcaaggactcgacgatcatcgtttccaacctggaagaggcctcgcgcggtaaaacctgggtcgaggacctcggtcgcagcggcgagccgcacaccggcagcaccttcatcatcggtaccgacagcaacgactggctcaagggcggggcgggcaacgacttcctggaaggacgcggcggcgatgaccgtttccgcgatgacggcggcttcaacattctgctgggcggccaagggcacaacacctttgaactgcagaagccgttgcagaacttcagctttgccaacgacggcgacggcacgctgtatgtgcgcgacgcctatggcggcatcagcatgacccgcgacatcggcgcgctggtgagcaaagaagcgggttcgtggtggggcagcaaggaaatcacctggaacgtcaccgccaagggtctgaccaacggcaacgaactgacccagtacaaccactcactcaacggcgacgcctacggcaatgccctgcacgcgactgccgagggtgactggctgttcggcctgggcggcgacgacaagctgatcagcgacaagggccatgtgaccttcgtcggcggcgctggcaacgacgtgatgacagcggtaggtggcaacaacacgttcctgttcagcggcgcgttcggtttcgatgccatcaacggctatcagggcagcgacaaactggtgttcatgggcgttgaaggcgtggggcagggctacgactacaagcagcacgcgtcgcagtcgggcaacgataccgtgctgaagattggcgactatgccgtgacgctgatcggggttggcgtggctaacctgtcggattcggcattcgtcttcgcctga

SEQ ID NO: 14 - protein, 562 aa, Unknown
  Obtained from an environmental sample.
MGLFDYKNADGKALYSDAIALTLYAYTPTGQPLPATAWAPVAATALGYQGKVGPQGTFFGEKDGFTSAEAEVLGKYDAAGKLIGIGIAFRGTGGLGYSDTFGDLKNNLLAAIGPSDYASNYAKNAFDNLLKAVAAFAIANGIAAKDVLISGHSLGGLGVNSVAELSAGNWGGFFKDANYVAFASPTQSSTGNNVLNIGYENDPVFRVLDGTTFSTASMGKHDKPHESTTDNIVNFNENYASTAQNLVPFSIINPMSWSAHSSLGYADGLNRVIDSKFYNLTSKDSTIIVSNLEEASRGKTWVEDLGRSGEPHTGSTFIIGTDSNDWLKGGAGNDFLEGRGGDDRFRDDGGFNILLGGQGHNTFELQKPLQNFSFANDGDGTLYVRDAYGGISMTRDIGALVSKEAGSWWGSKEITWNVTAKGLTNGNELTQYNHSLNGDAYGNALHATAEGDWLFGLGGDDKLISDKGHVTFVGGAGNDVMTAVGGNNTFLFSGAFGFDAINGYQGSDKLVFMGVEGVGQGYDYKQHASQSGNDTVLKIGDYAVTLIGVGVANLSDSAFVFA

SEQ ID NO: 15 - DNA, 858 bp, Unknown
  Obtained from an environmental sample.
atgaatattgttctagcacacggcattctcggcttcaaaaagattcctatcctgaatctggagtacttcaacggcgtgaaggcgcatctggaagataaatttaatgcgcgggtattggtcacgaaagtcgaccccgtcgcaggtatagaaaaacatggcgaccagttgtacgaacagattacggcggcgctcggccatactgggactgagccgactctcgaccccagcaaaaaggttcacatcatagcccacagcatgggcgggctggatgccaggtaccttctgtcgaagaatgaaaatggcatcgcagattacgtgagtacgctaacgactgtaagcactccgcacacaggatcgcctttggcggattttttctattcggcctttgacggtgagtcaaatattccgattttgggtaccctgatcagcgcagtcgaaaatggcgcccgggaggtgctcgacaatctggatataattgatgggctgagggatttaaccacttcaaacatgagtgagttcaacaaaaattatcaagataacaacagcgtcaagtatttctgtgttgccgggcagggccgtaatgattcattcgcaaaaacctgcattgcgctgctaccaacctatgcttacatcaagacaaagactggatcggaggaagcaaacgatggtttggtaccgatatcttcagcccttcgggagggttgggagaggataggcgagccttggcctttcgatcattttcaggaaatcggacataatctcgaccatggcttggacgtcctgcatcaggaagtttttcatcttggcaagtacgaagaaattgtggaacggttacaggcgcttgagaaggagagctag

SEQ ID NO: 16 - protein, 285 aa, Unknown
  Obtained from an environmental sample.
MNIVLAHGILGFKKIPILNLEYFNGVKAHLEDKFNARVLVTKVDPVAGIEKHGDQLYEQITAALGHTGTEPTLDPSKKVHIIAHSMGGLDARYLLSKNENGIADYVSTLTTVSTPHTGSPLADFFYSAFDGESNIPILGTLISAVENGAREVLDNLDIIDGLRDLTTSNMSEFNKNYQDNNSVKYFCVAGQGRNDSFAKTCIALLPTYAYIKTKTGSEEANDGLVPISSALREGWERIGEPWPFDHFQEIGHNLDHGLDVLHQEVFHLGKYEEIVERLQALEKES

SEQ ID NO: 17 - DNA, 1854 bp, Unknown
  Obtained from an environmental sample.
atgggtgtgtatgactacaagaactacagcacggcggactccaaggcgttgttcagcgacgccatggcaatcacgctgtattcctatcacaacctcgacaacggctttgccgtcggttatcagcacaacggctttggcctcggcttgccggccacgctggtcagcgcgctgatcggcggcaccgattcacaaggggtgattcccggtcttccctggaaccccgattcggaaaaagccgcactggacgccgtgcgcaaggccggctggacgccgatcactgccgcgcaactgggctatgacggcaagaccgacgtgcgtggaaccttcttcggcgaaaaggcgggctacaccagcgcccaggtggaaatcctgggcaagtacgacgccgagggccatctcaccgagatcggcattgcctttcgtggcaccagcgggccacgggaaatcctcatcggtgactccattggcgatgcgatcaacgacttgctcgccgccttcggccccaaggactacgccaagaactacgtcggtgaagcgttcggcagactgatggccgacgtggcggcgttcgccaaggccaacgggctgaccggcaaggatgtactggtcagcggccacagcctgggcgggctggcggtcaacagcatggcggacctgagcggcggcaagtggggcgggttcttcaatgactcgaactacatcgcctacgcctcaccgacccagagcagcaccgataaagtgctcaacgtcggctacgaaaacgatccggtattccgcgccctggacggttcgaccttcaccggcgcctcgcttggcgttcacgatgcgcccaaggcatcggccaccgacaacatcgtcagtttcaacgatcattacgcctcgaacgtgtggaatgtgctgccgttttccatcgtcaacattcccacctggatctcgcacctgcccaccgcgtatggcgacggcatgaaccgggtgatcgagtcgaagttctacgacctcaccagcagggattcgacgatcatcgtcgccaacctctcggatccggcgcgcggcaatacctgggtgcaggatctcaatcgcaacgccgagactcacaagggcagcactttcatcattggcagcgacgccaatgacttgatccagggcggcagcggcaacgattacctggagggccgcgccggcaacgacacgttccgcgacagcggcggttacaacatcattctcggcgggtcgggcagcaataccctggaactgcagaagtcggtgaacagttttgactttgccaacgacggcgccggcaacctgtacatccgcgatgccaagggcgggatcagcatcacccgcgacatcggcagcattgtcaccaaagagccggggttcctgtgggggctgttcaaggacgacgtgacccacagcgtgaccgccagcggcttgaaggtgggcaacaacgtcacgcagtacgagtccagcgtcaaaggcagcgcgggcgccgatacgctcaaggcgggggccggtggcgactggctgttcgggctggagggcaacgatcatctgatcggcgggattggcgacgacgtgtttgtcggcggtgcgggcaatgacctgatggagtccgggggtggggcggatacgttcctgttcagcggcgcgttcggcaatgaccgggtgctgggctacacggcgaacgacaaactggtgttcctcggcgtgcagggcgtgttgcccaacgacgatttccgtgcccatgccacggcggtcgggcaggatacggtgctcaagttcggcgccgattcggtgaccctggtcggggtttcattgagcagcttgaatggcgacgggattgtgatcgcctga

SEQ ID NO: 18 - protein, 617 aa, Unknown
  Obtained from an environmental sample.
MGVYDYKNYSTADSKALFSDAMAITLYSYHNLDNGFAVGYQHNGFGLGLPATLVSALIGGTDSQGVIPGLPWNPDSEKAALDAVRKAGWTPITAAQLGYDGKTDVRGTFFGEKAGYTSAQVEILGKYDAEGHLTEIGIAFRGTSGPREILIGDSIGDAINDLLAAFGPKDYAKNYVGEAFGRLMADVAAFAKANGLTGKDVLVSGHSLGGLAVNSMADLSGGKWGGFFNDSNYIAYASPTQSSTDKVLNVGYENDPVFRALDGSTFTGASLGVHDAPKASATDNIVSFNDHYASNVWNVLPFSIVNIPTWISHLPTAYGDGMNRVIESKFYDLTSRDSTIIVANLSDPARGNTWVQDLNRNAETHKGSTFIIGSDANDLIQGGSGNDYLEGRAGNDTFRDSGGYNIILGGSGSNTLELQKSVNSFDFANDGAGNLYIRDAKGGISITRDIGSIVTKEPGFLWGLFKDDVTHSVTASGLKVGNNVTQYESSVKGSAGADTLKAGAGGDWLFGLEGNDHLIGGIGDDVFVGGAGNDLMESGGGADTFLFSGAFGNDRVLGYTANDKLVFLGVQGVLPNDDFRAHATAVGQDTVLKFGADSVTLVGVSLSSLNGDGIVIA

SEQ ID NO: 19 - DNA, 933 bp, Unknown
  Obtained from an environmental sample.
atgaaacacctgttgtcgcgcagcgcattcgtcctcgccttgctcatgttgccgttcgcatcggccttcgcgtcctccggctacacccaaacccgctatcccatcgtgctggtgcatggcctgttcggctttggccagatgctgggggtggattatttctaccaggtgccggccgcgttgaaggctgacggcgcccaggtatacgtggccgaggtttccgccaccgacagcaacgaggcccgcggcgagcaattgctgcagcaggtgcagaagatcctggccatcaccggcgcgcagaaggtcaacctgatcggccacagccagggcgcgcccaccgcgcgctacgtggccggcgtgcggccggacctggtggcttcggtcaccaccataggcggcgtcaacaagggctccaccgtggccgacatcgtgcgcggcgcggcgcctgcgggcacggtttccgaagcggtggccgccgccatcgccggcgctttggccaaggtgatcgccttcttctccggcaccagcgacctgccgcagcagccgattgccgcgttgaactcgctgaccaccgccggctcgctggccttcaacgccaagtttccggccggcgtgccgcgctcggcttgcggcgaaggcgactaccaggtcaacggcgtgcagtactactcgtggaccggcgcggccaccaccaccaatgtgctggatccgctgaccatcccgatgggcgtgttgggcctggctttcggctccactgcgtccgacggcctggtggcggtgtgctccgcgcacctggggcaggtgatccgcgacgactacaagatgaaccacgtcaacgaaatcaaccagagcttcggcctggtcagcctgttcgaagtcagcccggtcagcctgtaccgccagcaggccaaccgcctgaagaacgcgggcttgtaa

SEQ ID NO: 20 - protein, 310 aa, Unknown
  Obtained from an environmental sample.
MKHLLSRSAFVLALLMLPFASAFASSGYTQTRYPIVLVHGLFGFGQMLGVDYFYQVPAALKADGAQVYVAEVSATDSNEARGEQLLQQVQKILAITGAQKVNLIGHSQGAPTARYVAGVRPDLVASVTTIGGVNKGSTVADIVRGAAPAGTVSEAVAAAIAGALAKVIAFFSGTSDLPQQPIAALNSLTTAGSLAFNAKFPAGVPRSACGEGDYQVNGVQYYSWTGAATTTNVLDPLTIPMGVLGLAFGSTASDGLVAVCSAHLGQVIRDDYKMNHVNEINQSFGLVSLFEVSPVSLYRQQANRLKNAGL

SEQ ID NO: 21 - DNA, 1482 bp, Unknown
  Obtained from an environmental sample.
atgaccttgattacgccaagctcgaaattaaccctcactaaagggaacaaaagctggagctcgcgcgcctgcaggtcgacactagtggatccctacggcatccccgccggcagcacgctggccgatgtcgcgggcggcacgcaggcgcagcccttcgatgtgaccctgtcgaagctcgcgaccgcggtctacggcacccgcggcgctccgccggaaggctggagcgcggtcagcgaccagcagctgcgcgacctcggcgtcgccgacccgaccgcgtggcggcagcagttcctcggcggcggcgagcagaccaaggcgcaggagttcaaggccgaggtctacaccgacggcaacggcaactacgtgctgtcctaccgcggcaccgccgagggctgggacgactggcagaacaacttcaagcagggcaccggcttccagaccgacccggtcgacaagttcagcggcaccgcggtcaacaccgcacgcgagttccagcgcgtgttcggcaacccgcccggcggcggggcgaccaacctggcgatcaccgggcactcgcagggcggcgggctggcgacggtcggctcgctcgcgaccggcgtgccggcggtgaccttcgacgcttcgggcatccatcccaacacgctcgatcgcatgggcctggacccgcaggccgcgcgcgacaccgccgagggcggccagatccgcgcctattcgctgagcagcgacctgctgacgcagacccaggagggcgggccgctgggcctgctcgcgcccgacgcgatgggcaccaagatcgtggtcgatcccgcgcgcgccgacgagcaccacatgatcgaccactacggcgcgatcgagctcgaaggcaagtcgccggaggagctggcgaagctcaacgcgctggtcgaggcggcgcgcaatacgccgtggatcccggccaacccgctgatcggcacgctgaccggcgtcgcgcacgtcggcggcggtaccgtgtattcggcgatgagccacagccccaacgcgttgaccgcggcgatgatcgatcggcagccctggcagaccggctacgagaatccctccgacgccggcaaggcgctgcaggacctggtgccggacgtgctcaaggacgacttcgcgcgcaacacccacgacaccgtccaggacgtcgtcgacgtggtcaacggcgacttcgcccgcggcgactacgtgcagggcggcttcagcatcgccggcgacgtcggcgagggcttctggaactcggtcggcgacaccgccaaccgcggcgccgacgcgctggcgcagaaggtcgacgacggcgtcgacggctgggcgggcgacgtgctctcgggcatcgtccgcggcggcggcgacgtgctgcagggcgcctccgacgcggtcgggcagggggtggaaacgctcgccgacggtgccggctacgtcgcgcagaagaccagcgacgccgtcggctggctgttcggccgctga

SEQ ID NO: 22 - protein, 493 aa, Unknown
  Obtained from an environmental sample.
MTLITPSSKLTLTKGNKSWSSRACRSTLVDPYGIPAGSTLADVAGGTQAQPFDVTLSKLATAVYGTRGAPPEGWSAVSDQQLRDLGVADPTAWRQQFLGGGEQTKAQEFKAEVYTDGNGNYVLSYRGTAEGWDDWQNNFKQGTGFQTDPVDKFSGTAVNTAREFQRVFGNPPGGGATNLAITGHSQGGGLATVGSLATGVPAVTFDASGIHPNTLDRMGLDPQAARDTAEGGQIRAYSLSSDLLTQTQEGGPLGLLAPDAMGTKIVVDPARADEHHMIDHYGAIELEGKSPEELAKLNALVEAARNTPWIPANPLIGTLTGVAHVGGGTVYSAMSHSPNALTAAMIDRQPWQTGYENPSDAGKALQDLVPDVLKDDFARNTHDTVQDVVDVVNGDFARGDYVQGGFSIAGDVGEGFWNSVGDTANRGADALAQKVDDGVDGWAGDVLSGIVRGGGDVLQGASDAVGQGVETLADGAGYVAQKTSDAVGWLFGR

SEQ ID NO: 23 - DNA, 837 bp, Unknown
  Obtained from an environmental sample.
ttgcgcactcgggagggcgtttgccgcgtgaaggacgatcccatcatcctggttcacggtctcttcggattcggagagttggccgtcggtggaaccacgctggtcgcgtatttccgcggcatccgtgagcatctgctcgcaacgggtttcaacgttccacctccgccgcagttgagcacggcgggcaccatcgctgagcgggccgacggtttgaaacgttacctcgagaactcgaccgaagtcggcggcaagccggtgcatttgattgcacacagcatgggcggcctcgactcacgatacctgattcgcaaattgcgaatggccgatcgagtcttgtcgttgactacgatcggcacgccccatcacggaagtccgatcgctgattttctgaaagcggggacctcgccgtccttgcaagcgctcgccgcgcgattcggattgggaggaatcgacaatttaacgacggacttctgtcgtgatttcaatcgcgattgtcccgatgaaccgaaaacttcgcatttgaagtactactcgatcgccggtcgctacgaaccgcgacgccttctcggattgccgaccgggttattggggccgactcacgatctcgttcaaaaagtcgaaggtgacaacgacggaatggtatcggtgagttcggcgagatacggaagcgatttggatcgctgggagccgttagggccgatctgggaggagagccattttcgtctcgtgaactgggacgacgacgtcgctgcggcgcttgggaatctccgcgaccggtcgattcccgcaaggtatcaagccatcgcggaacacgtcacgtcggtcccgcgacgctag

SEQ ID NO: 24 - protein, 278 aa, Unknown
  Obtained from an environmental sample.
MRTREGVCRVKDDPIILVHGLFGFGELAVGGTTLVAYFRGIREHLLATGFNVPPPPQLSTAGTIAERADGLKRYLENSTEVGGKPVHLIAHSMGGLDSRYLIRKLRMADRVLSLTTIGTPHHGSPIADFLKAGTSPSLQALAARFGLGGIDNLTTDFCRDFNRDCPDEPKTSHLKYYSIAGRYEPRRLLGLPTGLLGPTHDLVQKVEGDNDGMVSVSSARYGSDLDRWEPLGPIWEESHFRLVNWDDDVAAALGNLRDRSIPARYQAIAEHVTSVPRR

SEQ ID NO: 25 - DNA, 648 bp, Unknown
  Obtained from an environmental sample.
atgaaagtgatttttgttaagaaaaggagtttgcaaattctcgttgcacttgcattggtgattggttcaatggcttttatccagccgaaagaggtgaaggcggctgagcataatccggttgtgatggtacatggtattggtggtgcctcttataacttttattctattaaaagttacttggttggacaaggctgggatcgaaatcaattatatgctatcgatttcatagacaaaacaggaaataaccgcaacaatggtccgcgtctatccagattcgtccaagatgtgttagacaaaacgggtgccaaaaaagtagatattgtggctcatagtatgggcggggcgaacacattatactatattaagaatcttgatggcggagataaaattgaaaacgttgtcacgattggtggagcaaatggactcgtttcaaacagagcattacctggcacagatccaaatcaaaaaattctttacacatctgtctatagttcagccgatctcatcgtcgtcaacagcctctctcgtttaattggcgcaaaaaacgtcctgattcacggcgttggacatatcggtctattaacctcaagccaagtcaaaggctatattaaagaaggactgaacggcggaggacagaatacgaattaa

SEQ ID NO: 26 - protein, 215 aa, Unknown
  Obtained from an environmental sample.
MKVIFVKKRSLQILVALALVIGSMAFIQPKEVKAAEHNPVVMVHGIGGASYNFYSIKSYLVGQGWDRNQLYAIDFIDKTGNNRNNGPRLSRFVQDVLDKTGAKKVDIVAHSMGGANTLYYIKNLDGGDKIENVVTIGGANGLVSNRALPGTDPNQKILYTSVYSSADLIVVNSLSRLIGAKNVLIHGVGHIGLLTSSQVKGYIKEGLNGGGQNTN

SEQ ID NO: 27 - DNA, 780 bp, Unknown
  Obtained from an environmental sample.
atgataaaaaacttcgacagagaaaattctagcttagtactgtccggtggtggtgctctgggtattgctcacttgggtgtactgcatgaccttgaaaaacaaaatattgtaccaaatgaaattgttggtacaagtatgggtggtatcattggtgcatctatggctatcgggatgaaagagaaagaaatactcgaagaaatcaaaaacttttccaatgtcttcaactggataaaattctctttttccggtaattctgttgtcgataacgagaagatcgctaagatatttgatactctttttaaagacagaaagatgacagatacggtgatccctcttaaactcatcgctacaaacttacataatggacataaaaaagtatttactgcttcggatgatgtactgatcaaagatgcaatactctcaacaatggcaatacccggtgtatttgaagaacatattattgatggtgaaacctatggcgacggttttctttgtgaaaaccttggtgtgaatgaggcaacattcaatgatgttttagctgtagatgtcatgggtgagaactcttttgaaaaagcaatgccggacaacttctttaaaacatcaaatgttttagaaatgtttgaaaaatcaatgcgactttttatttacaaccagacacagacacatattaaaaatgcaaataaaaatatttatcttattgaacccgttaccaaagagtataaaacatttcaatttcataaacataaagagatacgtgctttaggcttgggtttactgtga

SEQ ID NO: 28 - protein, 259 aa, Unknown
  Obtained from an environmental sample.
MIKNFDRENSSLVLSGGGALGIAHLGVLHDLEKQNIVPNEIVGTSMGGIIGASMAIGMKEKEILEEIKNFSNVFNWIKFSFSGNSVVDNEKIAKIFDTLFKDRKMTDTVIPLKLIATNLHNGHKKVFTASDDVLIKDAILSTMAIPGVFEEHIIDGETYGDGFLCENLGVNEATFNDVLAVDVMGENSFEKAMPDNFFKTSNVLEMFEKSMRLFIYNQTQTHIKNANKNIYLIEPVTKEYKTFQFHKHKEIRALGLGLL

SEQ ID NO: 29 - DNA, 732 bp, Unknown
  Obtained from an environmental sample.
ttgagcgctcgcgggcccgccctcgtgctggcgctgttcgtcgccgcggggtgcgggccttcgctcgaggtgctgaccgccggcgggagcgggccgccgacgctcgtgctgttgcacggctacggatcatcggccgaggagtggcgtcctttcacggacacgatcgagtggccggcgccggggcggttcgtgtttccgcaggggccgggagccacccaaaggcccggcgggcgcgcgtggtggccgctcgagctccaggtattttcgaggaccgaccgtgccgcgcccgatctgtcccggacgcggccgcgcgggttgcagcccgcggccgcagcggtttccggccttcttcgacgcctcggctggtcgcccggcggggacatcgttctcggcggcttctcgcaaggcgcgatggtagcgagcgaagtggcgttccgttcaaacgctcgtcttgcggcgctcgtcctgctttcgggcactcccgtcgacgagccatcgtggcaacgcggctatccggcccggcgcggcttgccggtgttcatcgcccacggtcgaaacgatccggtgttgccattcgcgggatcggagcggatgcagcgcgacctcgcggcggccggtctgcgcgtgacgtgggtcccgttcgacggcggccacgaaatccccgccgaagtcgtcgtcgccttgaacgcgttcctgcgcgcgttgcgcgaggcgaagcagcctagcgcctga

SEQ ID NO: 30 - protein, 243 aa, Unknown
  Obtained from an environmental sample.
MSARGPALVLALFVAAGCGPSLEVLTAGGSGPPTLVLLHGYGSSAEEWRPFTDTIEWPAPGRFVFPQGPGATQRPGGRAWWPLELQVFSRTDRAAPDLSRTRPRGLQPAAAAVSGLLRRLGWSPGGDIVLGGFSQGAMVASEVAFRSNARLAALVLLSGTPVDEPSWQRGYPARRGLPVFIAHGRNDPVLPFAGSERMQRDLAAAGLRVTWVPFDGGHEIPAEVVVALNAFLRALREAKQPSA

SEQ ID NO: 31 - DNA, 735 bp, Unknown
  Obtained from an environmental sample.
atgcgcggcagctcccgaaaattgggcgtcgtgctgtgccacggctacatggccgctccggctgaggtcgaaaccctggcagagtatctcggcgggaagggatattgggtctatgccccccggttaaaagggcatggcacggcacccgaggatttggcccgctgcagccacaaggattgggtgcggtcagtggaggagggatacctgctggtacgcaatcgctgtgaccgggtggtggtgggtggcttttccaccggagcggccctggccctggagttggccggtcgggttgccggtttgacaggggtgttcgccgtagctacgcccctgcggctgcaatatgccgcttcaaagctggcgccggtggtggatacctggaaccgattgatgggcaaggtgcgctgggaagaggccaaaaaagagttcgtggaaaaccggccggaaaacccccacatcaattacgggcgcaatcccatctccggtgtgcgggaattggagcgtttgatggatctggtggagccccggttgccggacatcactgttccggccatggtgatccaatcgctggaggatccggtggtgcatcccaaaggctcggagcggatttttcactccctcggatcggtagacaagcagtatgtgctgttcgatttcaaacggcacgggattttgctcggggagggttccgagcgggtgcatcatacgatcggtgccttcattgatcggttgcgctaa

SEQ ID NO: 32 - protein, 244 aa, Unknown
  Obtained from an environmental sample.
MRGSSRKLGVVLCHGYMAAPAEVETLAEYLGGKGYWVYAPRLKGHGTAPEDLARCSHKDWVRSVEEGYLLVRNRCDRVVVGGFSTGAALALELAGRVAGLTGVFAVATPLRLQYAASKLAPVVDTWNRLMGKVRWEEAKKEFVENRPENPHINYGRNPISGVRELERLMDLVEPRLPDITVPAMVIQSLEDPVVHPKGSERIFHSLGSVDKQYVLFDFKRHGILLGEGSERVHHTIGAFIDRLR

SEQ ID NO: 33 - DNA, 633 bp, Unknown
  Obtained from an environmental sample.
atgaagaaaacgtttgtcgcattaattcttgctttatccctggttgtatctgcattaggaattcagccttcgaatgctaaagctgaatcaaatcacaatccggttgttcttgttcatggaatcagcggtgcgtcctataactttattgctatcaaaaactacttaattgctcaaggttgggatcgcaatgatctttatgctattgattttgtagataagacaggcaacaatttgaataatggacctcagcttgctcgatacattgatcaagtgttgaaagagacgggagctaagaaggtagatattgttgctcatagtatgggcggagcaaacacgctgtattatattaaatatctagggggagggaataagattgaaaatgtcgtgacgttaggaggagcgaatggtttagtttcttcgacagcactcccaggtacagatctcaatcaaaaaattctttatacgtcgatctacagcataaatgatcaaattgttgctaatagtctctctaggctgcaaggagcaagaaacattcaactttatggcattggacatattggattgctttcaaatagtcaggttaacgcgtacataaaagaagggctgaatggcgggggacaaaatacaaactaa

SEQ ID NO: 34 - protein, 210 aa, Unknown
  Obtained from an environmental sample.
MKKTFVALILALSLVVSALGIQPSNAKAESNHNPVVLVHGISGASYNFIAIKNYLIAQGWDRNDLYAIDFVDKTGNNLNNGPQLARYIDQVLKETGAKKVDIVAHSMGGANTLYYIKYLGGGNKIENVVTLGGANGLVSSTALPGTDLNQKILYTSIYSINDQIVANSLSRLQGARNIQLYGIGHIGLLSNSQVNAYIKEGLNGGGQNTN

SEQ ID NO: 35 - DNA, 1425 bp, Unknown
  Obtained from an environmental sample.
atgggtgtgtttgactataaaaaccttggggccgagggctccaaggccttgtttgccgatgccatggcgatcacgttgtatacctaccacaacctggataacggctttgccgtgggctaccagcacaatggcctgggcgtcggcttgccggctactctggtcggcgcattgctcggcagtacggactcccagggtgtgatcccaggcattccctggaacccggattcggagaaggccgcgctcgaagcggtgcagaaggccggctggacgcccatcagcgccagcaccctcgggtataccggcaaggtcgacgcccggggcacgttcttcggcgaaaaggccggctacaccacggcccaggtcgaggtgctgggcaagtacgatgacgcgggccagttgcaggaaatcggcatcggttttcgcggcacgtctggcccaagggaaacactgatcaccgactccatcggcgatctggtcagcgacctgcttgctgcgctgggtcccaaggattacgcaaagaactacgccggcgaagcattcggcggcttgctcaagagcgtcgccgagtatgcggcggcccacggtctcagcggccaggatgtgctggtcagcggccatagcctcggcggcctggcggtcaacagcatggccgacttgagcgacgccaagtggtccgggttctataaggacgccaactacttggcctacgcctcaccgacccagagtgccagcgacaaggtgcttaatatcggctacgaaaacgacccggtgttccgcgccctggacggctcatccgccaacctgtcgacgctcggtgttcacgacaaaccccacgagtccaccactgacaacattgtcagcttcaacgatcactacgcctcgaccctgtggaatgtgctgccgttttccatcgccaatctgccgacttggatctcgcacttgccgaccggctacggcgacggcatggggcgcattctggagtccgggttctatgaacagatgacccgggactcgacgattatcgtggccaatctatccgacccggcacgggccaccacttgggttcaggacctgaaccgcaacgccgaaccgcacacaggcgacactttcatcattggcagcgatggcgatgatctgatcctgggcggcaagggcgcggactttatcgaaggcggcaagggcaatgacacgatccgcgacagcagcgggcataacacctttttgttcagcggccagtttgggcaggatcggattatcggttatcagccgacggataaactcgtgttccagggtgtggcgggcagcggggattaccgtgatcacgccaaggtggtgggtggggatacggtgatcagtttcggggcggattcggtgacgttagtgggcgttagcggggtgttgggggagggggttgtgatcggctga

SEQ ID NO: 36 - protein, 474 aa, Unknown
  Obtained from an environmental sample.
MGVFDYKNLGAEGSKALFADAMAITLYTYHNLDNGFAVGYQHNGLGVGLPATLVGALLGSTDSQGVIPGIPWNPDSEKAALEAVQKAGWTPISASTLGYTGKVDARGTFFGEKAGYTTAQVEVLGKYDDAGQLQEIGIGFRGTSGPRETLITDSIGDLVSDLLAALGPKDYAKNYAGEAFGGLLKSVAEYAAAHGLSGQDVLVSGHSLGGLAVNSMADLSDAKWSGFYKDANYLAYASPTQSASDKVLNIGYENDPVFRALDGSSANLSTLGVHDKPHESTTDNIVSFNDHYASTLWNVLPFSIANLPTWISHLPTGYGDGMGRILESGFYEQMTRDSTIIVANLSDPARATTWVQDLNRNAEPHTGDTFIIGSDGDDLILGGKGADFIEGGKGNDTIRDSSGHNTFLFSGQFGQDRIIGYQPTDKLVFQGVAGSGDYRDHAKVVGGDTVISFGADSVTLVGVSGVLGEGVVIG

SEQ ID NO: 37 - DNA, 2241 bp, Bacteria
atgaaaaatagagaaaataaatatagtattcgtaaatttagtgtaggaacatcttccattttaatcgcagcattattatttattggtggaggttctgctcaagcagctgaaaatcaagataagggaaatgttgattcagaagcacaacaagcacaatctattggggaacaacagggaaatgatgttaaaaatgaacaaacaaatcaatctagtgaattaaaagaacgtaacgatagcgttgaagcacaaaatgacaatcaacaagatgcaacaccaacaagcttacataaagaaacatctgagaaagatactacacaaacgtcacaagacaatactgaagagaaacaaacaaaagatgcaacagtagaaactgagcaatcagctaatcaagtgcaacaagatgttaaaacaactaaagaaaaaacaacagaagatcaagcaacaaagtctgttgaaaaatctgatgctacaacgccaaatcaaaaggacaaagctgatggcaaagcaacaaaagaagaaacgccaacacctagtccaaaggcgcaagataaagcatcatcaactcaaacgcatcaacatgatgtagatccagaatttaatagcaaacataaagcttcacaagtggatccagaatttagtcataagcaagcgcaaaagaaagcggatgtagattcagagttcaataaaaatcataaagcgcaacaggtcgatccagatttctctcgacgtcatgctacagaaaaagcgactcatgctactgtgaataaagaaaaagcagatgccacaattaatcaaaaagaccaacaaaaagtgacagcacaatcagttgatcaaaaagctacagctccgaagcaaactgattcatctcaaaaatcaaaacaaaagcaacctgtctctcttgaacaattagaaaaagattcaccattattatcaaaagataatccaagtaaaaaagataaagaacaaaaagacggtttacaagcgctaaaatcgaattcagttgccacattaaataatcagtctaaaaataaagtagctgtagcagataaagaccaaacaaataagaaagctaaacaacaacagtataaaaatcatgatcctatcattctcgttcatggatttaatggattcactgatgatattaacccagctgttttatcacattattggggtggcgataaaatgaatattcgccaagatttagaagaaaacggctacaaatcatatgaagcaagtatcagtgccttcggtagtaactatgacagagcggtagaactatactactatatcaagggtggtcgtgtagattacggtgcagcacatgctgcgaaatatggtcatgagcgatatggtaaaacatatgaaggtgtatataaagactggaaaccaggtcaaaaagtgcacttagttggtcatagtatgggtggacaaacgattcgccaacttgaagaacttttaagaaatggtaaccaagaggaaattgagtatcagaagaaacatggtggtacaatttcaccattattcaaaggcaataatgataatatggtttcttcaattacgacacttggtacaccacataatggtacacacgcttcagatgtattaggtaatgaagcggttgtaagacaggttgtttatgatattggtaaagcctttggtaataaagattcaagagtcgactttggtttatctcaatggggcttaaaacaaaaaccaaatgaatcatatatcgattatgctaaacgtgtgaaaaactctaagttatggaaatcacaagacaatggtttctatgatttaactcgagatggtgcaacagacttaaaccgtaaaacatcattaaatccaaatattgtatataaaacatatactggtgaggcaacacatccatcactatttggtagacaaaaagcagatttaaacatgttcttaccatttattttaactggaaatgtgatcggtaaagctaacgaaaaagaatggagagaaaatgatggacttgtatctgtgatttcttcacaacatccatttaatcaaaaatatacacaagcaacagataaaaaccaaaaaggtatttggcaagtaacacctacaaaacatgattgggatcatgttgactttgttggacaagatagttctgatacagtaagaactagagaagaattacaacaattctggcatggtctagcagatgatttagtacaaagtgaaaagttaacatcagagcaaaaagcacaagcataa

SEQ ID NO: 38 - protein, 746 aa, Bacteria
MKNRENKYSIRKFSVGTSSILIAALLFIGGGSAQAAENQDKGNVDSEAQQAQSIGEQQGNDVKNEQTNQSSELKERNDSVEAQNDNQQDATPTSLHKETSEKDTTQTSQDNTEEKQTKDATVETEQSANQVQQDVKTTKEKTTEDQATKSVEKSDATTPNQKDKADGKATKEETPTPSPKAQDKASSTQTHQHDVDPEFNSKHKASQVDPEFSHKQAQKKADVDSEFNKNHKAQQVDPDFSRRHATEKATHATVNKEKADATINQKDQQKVTAQSVDQKATAPKQTDSSQKSKQKQPVSLEQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDVLGNEAVVRQVVYDIGKAFGNKDSRVDFGLSQWGLKQKPNESYIDYAKRVKNSKLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 39 - DNA, 783 bp, Unknown
  Obtained from an environmental sample.
atgacacgaaaaaaaatcggcttggctttatccggcggcgcggcgcgtggcttcgcacatctcggagttttgaaagttttcgccgaacacggcattcccgtcgatttcgtcgccggaacgagcgccggttcgtttgcgggcgcggctttcgcttccggtttaagcgtggcggaaatcatcgaaatgtcaaggaaaatcagttggtttcggatgaccggattttcgtactcgccgaaaggcttgctgtcgaacgcgccgatgggagcgtttatcaatcagcattttccgcgcaaaaaatttgaagaactgccgataccgttcgcggcaattacgtgcgatctcgaaaccggcgaggaaatcgtgcttaaagaaaccggcgacgtggcgactgccgtccgtgcgagctgcgcgctgcccggcgtcttcgtgccaatcgaatacggcggacggcgattgatagacggcggcgtcgtgtcgaacgtgccgacgagagccgtcaaaaagctcggcgcggaaatcattattgcggttgacgttctggcgtgcggcacaacttactggggttcgccttccactttgctcggcatctttttccaatcggcgatgatgcttctccgcgccgcttcaaaatctcatcattaccgcgcgagcgtcgtcatcacgccgcaaatcgctcatctgcgcccggacgaaatcagcaaaatggacgaatttatcaaagcgggcgaacaagccgcgcttgaaaaagttgacgaaatcaaggctttgctcgccgaacaataa

SEQ ID NO: 40 - protein, 260 aa, Unknown
  Obtained from an environmental sample.
MTRKKIGLALSGGAARGFAHLGVLKVFAEHGIPVDFVAGTSAGSFAGAAFASGLSVAEIIEMSRKISWFRMTGFSYSPKGLLSNAPMGAFINQHFPRKKFEELPIPFAAITCDLETGEEIVLKETGDVATAVRASCALPGVFVPIEYGGRRLIDGGVVSNVPTRAVKKLGAEIIIAVDVLACGTTYWGSPSTLLGIFFQSAMMLLRAASKSHHYRASVVITPQIAHLRPDEISKMDEFIKAGEQAALEKVDEIKALLAEQ

SEQ ID NO: 41 - DNA, 813 bp, Unknown
  Obtained from an environmental sample.
atggaatcgacgattcagccgctcgaccgcgtgtttttgcaccttggccccattacgatttattggtatggggtcattatcggcaccggtgtgttgattgggctatggctcgcgacgcgcgaagcggtgcggcgcggcttgccgaaagagacgtttgtcgatttggtgttatttgccgtgccgatcgccattgtctgcgcgcgggcgtactacgtgctgtttgaatggcactattattcaaagcatttgtccgagattccaaaagtttggcaaggcggcctcgccattcacggcggtttgatcggggcggtggcgacgggcgcggtgttcgcccgcgcgcgcgggctgtcgttttggaagctcgccgatattgccgcaccaagcatcattttaggccaggcgatcgggcgctggggcaattttatgaaccaagaggcgcacggcggccctgtgtcgcgccagtttcttgaaaatttgcatttgccggattggatcatcaatcaaatgtacattgacggccgttattggcatccgacttttttatatgagtccctttggaacctcgtcggctttttcttgcttctttggctgcggcgcgtcaatttgcggcgcggcgagctgtttttgtcctatttgatttggtattcggttggccgtttctggattgaagggatgcgcaccgacagcttgatgctggccggcagtctgcgcgcggcgcaagtcgtatccgtgacgctgatcgtgttgtcgatcgcgctgtggatcgtgcgccgggcgaaaggatgggcaaaagcaaggtatcaagacgaatag

SEQ ID NO: 42 - protein, 270 aa, Unknown
  Obtained from an environmental sample.
MESTIQPLDRVFLHLGPITIYWYGVIIGTGVLIGLWLATREAVRRGLPKETFVDLVLFAVPIAIVCARAYYVLFEWHYYSKHLSEIPKVWQGGLAIHGGLIGAVATGAVFARARGLSFWKLADIAAPSIILGQAIGRWGNFMNQEAHGGPVSRQFLENLHLPDWIINQMYIDGRYWHPTFLYESLWNLVGFFLLLWLRRVNLRRGELFLSYLIWYSVGRFWIEGMRTDSLMLAGSLRAAQVVSVTLIVLSIALWIVRRAKGWAKARYQDE

SEQ ID NO: 43 - DNA, 711 bp, Unknown
  Obtained from an environmental sample.
atgttcttgattcatgcgcggttgcggctatccgcggggattgcgctggcgtcgctggcggctcttgtgtccgcctgcggcggcgcctcggcccctgccgaagcccctcagtcagcgtctgcgcaggatccgaacgcgccgccggcccggcccaaggtcgtcattctcggcgacagcctgaccgccggacttggtctcgtcgaatcgcagtcctttccggcgcgcctgcagcagcgggtagacgaggaaggctacgcgttcgacgtggtcaacgcgggtgtgtccggtgacacgtcagcgggcggcttgcggcgtctggactgggcgctcgagggggacgtgcgcgtgctcgtggtcgcgctcggcgccaacgacggtctccgcggcctgtcggtctccgacatgaaaaagaacctcgcggcgatcatcgcgcggggcaaagcgcgcggcgtcaccgtgatcctggccggcatggaggcgccccccaactacggacaggaatacgccgccgcgtttcgacaagccttccgccaggtggccctcgagcagcgcgtgctcttcatcccgtttctgctgcaggacgtggcgggtcactcggcgctgaaccagtccgacggcatccatccgaacgccgacggtgcgtcccgggtcgcggagacggtttggggcgtgctcgggccgacgctcgatcagatggcggccgcttcatga

SEQ ID NO: 44 - protein, 236 aa, Unknown
  Obtained from an environmental sample.
MFLIHARLRLSAGIALASLAALVSACGGASAPAEAPQSASAQDPNAPPARPKVVILGDSLTAGLGLVESQSFPARLQQRVDEEGYAFDVVNAGVSGDTSAGGLRRLDWALEGDVRVLVVALGANDGLRGLSVSDMKKNLAAIIARGKARGVTVILAGMEAPPNYGQEYAAAFRQAFRQVALEQRVLFIPFLLQDVAGHSALNQSDGIHPNADGASRVAETVWGVLGPTLDQMAAAS

SEQ ID NO: 45 - DNA, 1425 bp, Unknown
  Obtained from an environmental sample.
atgggcgtgtttgactataaaaaccttggggccgagggctccaaagcgttgtttgccgatgccatggcgatcacgttgtatacctaccacaacctggataacggctttgccgtgggctaccagcacaatggcctgggcgtcggcttgccggctactctggtcggcgcattgctcggcagtacggactcccagggtgtgatcccaggcattccctggaacccggattcggagaaggccgcgctcgaagcggtgcagaaggccggctggacgcccatcagcgccagcaccctcgggtataccggcaaggtcgacgcccggggcacgttcttcggcgaaaaggccggctataccacggcccaggtcgaggtgctgggcaagtacgatgacgcgggccagttgcaggaaatcggcatcggttttcgcggcacgtctggcccaagggagacgctgatcaccgactccatcggcgatctggtcagcgacctgcttgcggcgctgggtcccaaggattacgcgaagaactacgccggcgaagcattcggcggcttgctcaagaacgtcgccgagtatgcggcggcccacggtctgagcggccaggatgtgctggtcagcggccatagccttggcggcctggcggtcaacagcatggccgatttgagcgaggccaagtggtccgggttctataaggacgccaactacttggcctacgcctcaccgacccagagtgccagcgacaaggtgcttaatatcggctacgaaaacgacccggtgttccgcgctttggacggctcatccgccaacctgtcgacgctcggtattcacgacaaaccccacgagtccaccactgacaacattgtcagcttcaacgatcactacgcctcgaccctgtggaatgtgctgccgttttccatcgccaatctgccgacctggatctcgcacttgccgaccggctacggcgacggcatggggcgcattctggagtccgggttctatgaacagatgaaccgggactcgacgattatcgtggccaatctatccgacccggcacgggccaccacttgggtgcaggacctgaaccgcaacgccgaaccgcacacaggcgacacttttatcattggcagcgatggcgatgatctgatccagggcggcaagggcgcggactttatcgaaggcggcaagggcaatgacacgatccgcgacagcagcgggcataacacctttttgttcagcggccagtttgggcaggatcgaattatcggttatcagccgacggataaactcgtgttcgagggtgtggcgggcagcggggattaccgtgatcacgccaaggtggtgggtggggatacggtgatcagtttcggggcggattcggtgacgttggtgggcgttagcggggtgttgggggagggggttgtgatcggctga

SEQ ID NO: 46 - protein, 474 aa, Unknown
  Obtained from an environmental sample.
MGVFDYKNLGAEGSKALFADAMAITLYTYHNLDNGFAVGYQHNGLGVGLPATLVGALLGSTDSQGVIPGIPWNPDSEKAALEAVQKAGWTPISASTLGYTGKVDARGTFFGEKAGYTTAQVEVLGKYDDAGQLQEIGIGFRGTSGPRETLITDSIGDLVSDLLAALGPKDYAKNYAGEAFGGLLKNVAEYAAAHGLSGQDVLVSGHSLGGLAVNSMADLSEAKWSGFYKDANYLAYASPTQSASDKVLNIGYENDPVFRALDGSSANLSTLGIHDKPHESTTDNIVSFNDHYASTLWNVLPFSIANLPTWISHLPTGYGDGMGRILESGFYEQMNRDSTIIVANLSDPARATTWVQDLNRNAEPHTGDTFIIGSDGDDLIQGGKGADFIEGGKGNDTIRDSSGHNTFLFSGQFGQDRIIGYQPTDKLVFEGVAGSGDYRDHAKVVGGDTVISFGADSVTLVGVSGVLGEGVVIG

SEQ ID NO: 47 - DNA, 882 bp, Unknown
  Obtained from an environmental sample.
atgctgcgttcgttcgtgtcgatgcgctcgttggtgtcgaaaggtcttgccgtcggcttactcgcgagcacactcgccgtgctggctcccggtccggtcgaagcccagtcgtccggcggggtgaacaactggcggtgccagccgtcccaggatcatcccaacccggtggtcctgctccacggtctcggcgccccgtcggacggccactggtcgtacctggccccgaagctggccggcgagggctactgcgtcttctacttcacctacggcaaggtcaccccgctcatccccctggggggcttcaggccaatagccgactcggctgccgagatcgaagcgttcatcgaccgcgtgctgagggcgacgggtgcgggcgaggtcgacatcgtcggtcactccgaaggcggcttcctgtccctgtacgtccccaagatgcgccaggcgggagacaaggtgggcactgtggtcgcgctggctcctcccacgcacggcaccaccttcgccgggctggtcgggatcgccgactacctcggggtgcgtcccctggtcaacgtcatcctgcggaccttcggctgtgacgcctgcaacgacctgatcacagacggtcccgccgtgcgcgaactgaccgacggtccggtagcggtggcgggtgtcgactacacgatcatcgtgagcaggttcgacgtgctggtcacaccggtggagacgtcgttcgtcgacgagcccggagtgaccaacatgtacgtgcaggacgactgcccgctcaacccggtcggtcacatcgggatggcgttcgacagcagtatcgccacgatgatcaccaacgcgctggaccccgacaacgccaagccggtgcgctgcaccatcggcctaccgttctag

SEQ ID NO: 48 - protein, 293 aa, Unknown
  Obtained from an environmental sample.
MLRSFVSMRSLVSKGLAVGLLASTLAVLAPGPVEAQSSGGVNNWRCQPSQDHPNPVVLLHGLGAPSDGHWSYLAPKLAGEGYCVFYFTYGKVTPLIPLGGFRPIADSAAEIEAFIDRVLRATGAGEVDIVGHSEGGFLSLYVPKMRQAGDKVGTVVALAPPTHGTTFAGLVGIADYLGVRPLVNVILRTFGCDACNDLITDGPAVRELTDGPVAVAGVDYTIIVSRFDVLVTPVETSFVDEPGVTNMYVQDDCPLNPVGHIGMAFDSSIATMITNALDPDNAKPVRCTIGLPF

SEQ ID NO: 49 - DNA, 792 bp, Unknown
  Obtained from an environmental sample.
atggtatctattggatttgaggagttaaaaaaaggggatttttcactggttctttctggaggaggggctttgggaattgctcatcttggagtaataagagacttagaaaaatctaatttaaaaccttctgaaattattggaactagcatggggggaattattggagcttgtgttgcaattggaatgagagaaaaagagatttttgaaaatatagaaagatttgctaaagtaggaaaatggataaaactctctttaagtggaaattcaattataaaaagtgaaaaaattgaagctatctttgatgaaatttttggagaaattaaaatttctcaaacaaaaattcctctaaaacttatttgtacgaatcttttgacaggtaaaaaaagagtatttaactcttctgacaacatagaattaaaaaaagctctactttgtacaatggcaattcctggaatttttgaggaacaaattatagatgatgaggtcttaggtgatgggtttttgtgtgaaaatttgggagtaaatgaggcaaaaaaagagtatcttttagcagttgatgtaatgggatatgattcattttctcatcaacttccaaaaaattttttaaaaactgcaaatattttggaaatgtttgaaagatcaatgagacttttaatatttaatcagactcaaaaccttcttagatgttgtgataaaaaaatctttcttgtctctccaaaaactaaagattataaaacttatcattttcataaggcatctgaaattagagaacttggaagaattttttcttaa

SEQ ID NO: 50 - protein, 263 aa, Unknown
  Obtained from an environmental sample.
MVSIGFEELKKGDFSLVLSGGGALGIAHLGVIRDLEKSNLKPSEIIGTSMGGIIGACVAIGMREKEIFENIERFAKVGKWIKLSLSGNSIIKSEKIEAIFDEIFGEIKISQTKIPLKLICTNLLTGKKRVFNSSDNIELKKALLCTMAIPGIFEEQIIDDEVLGDGFLCENLGVNEAKKEYLLAVDVMGYDSFSHQLPKNFLKTANILEMFERSMRLLIFNQTQNLLRCCDKKIFLVSPKTKDYKTYHFHKASEIRELGRIFS

SEQ ID NO: 51 - DNA, 915 bp, Unknown
  Obtained from an environmental sample.
gtgactatcgctttaacccttcctctcttatcgtgttcctctgagcaaagtaccccgcagcccttaccaacctcgctaccgatggctacccagacctcctccgctttgcccatcccttttaatcgatatggcgagacgctgacgaacatcacatactgcacgccggataattctccccaaatgctggatatttactttccggactcaggtggaccctggcccgtgttggtttacattcacggcggcagttggatgtatggtgacaagtcggaaccgatgatctccctgtttgccagcgggatgaacgcgcagggctatctggtggttcccgttaattatcggttgtatcccgatgcatcatttcccgctatgatccaggatgtgaaatgcgcggtccgttttctgcgagcgcacgcagcggagtacaacctggacccgaaccgcgtgggcgcggtgggtgtgagtgcaggcggacatctcgcgtcgctgctggggactacagatgtaagcgcaggttgggatgtgggggagtatcttgaccaatcgagcagtgtccgagcagtgattgccattgccggagtcatggacttgtcgcgacccatccccaatgccgatctcgaaacgatggagcgaatgggattcggcagccagaatgcgatgaacgccagcccaattacgcatgtaaccgcagactcgtcgccgtttttactaatccacggcgaccgcgatgaggtcgtccctgtggaacaatcgcagttgatgtacgaccgcctgctgctggaacaagtcccggcgcagttggtggtgatccagaatgcacagcattctttcattgctccggacgaaaccacaacgcccacgcttccagagatcaatcagatcattcaggatttcctggcacgatatctaaaatag

SEQ ID NO: 52 - protein, 304 aa, Unknown
  Obtained from an environmental sample.
MTIALTLPLLSCSSEQSTPQPLPTSLPMATQTSSALPIPFNRYGETLTNITYCTPDNSPQMLDIYFPDSGGPWPVLVYIHGGSWMYGDKSEPMISLFASGMNAQGYLVVPVNYRLYPDASFPAMIQDVKCAVRFLRAHAAEYNLDPNRVGAVGVSAGGHLASLLGTTDVSAGWDVGEYLDQSSSVRAVIAIAGVMDLSRPIPNADLETMERMGFGSQNAMNASPITHVTADSSPFLLIHGDRDEVVPVEQSQLMYDRLLLEQVPAQLVVIQNAQHSFIAPDETTTPTLPEINQIIQDFLARYLK

SEQ ID NO: 53 - DNA, 1371 bp, Archaea
atgcttagggctgttgctctggttatggcgctgctgttgattcctgccgctggagcgtttgagtacctcggcgaggtttacacggcaaaaacggatgacggagtaaaaatcaagctgctgagataccacccgccgggagaaggtgtaaacgacggtgtacagccggttgtgctgttttcggggctgctctgcaacatgaacgaatacctgactcacacacctccggaactcaaagacctctacaaaactcagcttccatcagagcttgcggactgggccgtgggggatgagagaatccagcaggaccccatgctttactacagccttgcatacaacctctggaagcagggatacgacgtctggctcgtgaactacagggggacgggcgttggggagctgaaaagcggtgtcggctctgcaagaacgagcctcgatacgtgggcgatttacgacacaaaggcggcgattacgaaggtttacgaggtgacgggaaagcatccggtgataggggggcacagcaccggtgggcttgtgagctacgtttacctgcagggcgctaaattcaaatggactttcgcctgccttttcaaaaagccgtggtgcaagaaggtcgtttcggatgatgatttggtgagggaaaggaacggattgaccgagggtgaggagactgttgttggagtaattgccctcgacccggcaatgattccaccactgcccaagctcacagacctgaagctgatgtggcttctcctcgacaccccgctttacatcgacatcagggggatcatgaatctaattgcgaagaacgacaggctgtggtgcgccactacccacactatagatgaggtctttgagctaatatttgagatgaacgaggagtacgggcagtacagcgaactcataagagatttaaccttcacaaaccccggcaacatgaatgacgagctgaacgatttccttgtaagatacgtcgctgacagcctctacactcccacactggcccactacaacgatttcggaactcacaggactgcgagggaatacttcgagaacggtggcagaagctacctaattgttcccccagaaccaaatcccggaaaggatggctactactattacattctgaacatgcagaaagtcagagtcccgttcataacgctgctctcagaatacgatgcgcttgttgaggcggaacagataatcagagacctgatggaggccaagacaccacaccagttcgacgagtactacataattgagggcacagcccatcttgacttgcccttcgggctgaaggcgccgagcgaggtttttccgaaagttggggcgtggctggagaaggtaagggtgtacccggtgactccccactga

SEQ ID NO: 54 - protein, 456 aa, Archaea
MLRAVALVMALLLIPAAGAFEYLGEVYTAKTDDGVKIKLLRYHPPGEGVNDGVQPVVLFSGLLCNMNEYLTHTPPELKDLYKTQLPSELADWAVGDERIQQDPMLYYSLAYNLWKQGYDVWLVNYRGTGVGELKSGVGSARTSLDTWAIYDTKAAITKVYEVTGKHPVIGGHSTGGLVSYVYLQGAKFKWTFACLFKKPWCKKVVSDDDLVRERNGLTEGEETVVGVIALDPAMIPPLPKLTDLKLMWLLLDTPLYIDIRGIMNLIAKNDRLWCATTHTIDEVFELIFEMNEEYGQYSELIRDLTFTNPGNMNDELNDFLVRYVADSLYTPTLAHYNDFGTHRTAREYFENGGRSYLIVPPEPNPGKDGYYYYILNMQKVRVPFITLLSEYDALVEAEQIIRDLMEAKTPHQFDEYYIIEGTAHLDLPFGLKAPSEVFPKVGAWLEKVRVYPVTPH

SEQ ID NO: 55 - DNA, 1260 bp, Unknown
  Obtained from an environmental sample.
ttgaaagtaaaaggaaaatacatattaaccatcatgactattattgtagtgttgctatttcctattgaaactcaagcggctttacagaccaatacttcgtcaaaacagaatgattatcccctcgtactagtccatggattaatgggttggggtaaaggagaagcactggggtataaatactggggaggacttaaggacatagaaaactatttgaatcaaaatggtcacaaaacatatgtagcgacggttggcccggtatcaagtaactgggatcgtgctgtagagctttattattatattaaaggtggacgagttgattatggagctgctcatgctaaagagcacagccattctaggtatggaaggacttttccgggaatctatagccaatgggataaaacgaataaaatacaccttgtcggtcatagtatgggtggacaaaccactagaacacttgttgaactactcgaaaacggcagtaaagaggagcaaatgtattataaggagcacagagacgaaggcatatcttccttgtttgaaggaaaaaaaagctgggtacatagtgtaactagtctcgccacacctcataatgggtcaacctttgctgaccaagaatcgctcattccttttattaaagagcttattattaagttagccagtacaaccggtgtatcaagcgagagtttagtttacgattttaaattagaacaatggggattaaaacgaaaccctgaagaaagcttcactgtttatttggatcgtgttttgaaaagtaaggtatgggaaagtgatgatattagctcatatgatttgtctacatatggagcccaggagctgaataattgggttaaaacacatccagatgtatactatttttcacacactgggaatgcttcctataaaggtctagtaacaggacatgcttatcctattttgacgatgaatccaattatgataggtcctagtaaattaattggttcatacactcgttttaacccagaacctatcattgataaatcatggttcccgaacgacggtctggtaagtgtagtttcatcgaaattcccagcaggccagccaaacaaaccaatggacggagctgttactgttacgaaaggagaatggaactacctttcaactatggaaggttgggatcacatggactttatcggtattctcggttcaaacacaccaggttactggaatatttatggttattataaagatatagcccagaaattacatgaattgccaaagtaa

SEQ ID NO: 56 - protein, 419 aa, Unknown
  Obtained from an environmental sample.
MKVKGKYILTIMTIIVVLLFPIETQAALQTNTSSKQNDYPLVLVHGLMGWGKGEALGYKYWGGLKDIENYLNQNGHKTYVATVGPVSSNWDRAVELYYYIKGGRVDYGAAHAKEHSHSRYGRTFPGIYSQWDKTNKIHLVGHSMGGQTTRTLVELLENGSKEEQMYYKEHRDEGISSLFEGKKSWVHSVTSLATPHNGSTFADQESLIPFIKELIIKLASTTGVSSESLVYDFKLEQWGLKRNPEESFTVYLDRVLKSKVWESDDISSYDLSTYGAQELNNWVKTHPDVYYFSHTGNASYKGLVTGHAYPILTMNPIMIGPSKLIGSYTRFNPEPIIDKSWFPNDGLVSVVSSKFPAGQPNKPMDGAVTVTKGEWNYLSTMEGWDHMDFIGILGSNTPGYWNIYGYYKDIAQKLHELPK

SEQ ID NO: 57 - DNA, 918 bp, Unknown
  Obtained from an environmental sample.
atgacgactgacgtcctgcctgcccccgatggtcacgccattttcctgcaccgctggctggcgcccggtgaatgccgcggcaccgtactgtggttgcatggtatggccgaacacggcgcccgctatgcgcctctggcagatgccctgaatgccaatgggtggaacctttactgccccgatcatcgaggccatggcggcagtgtccgcgatgagagcctgcgcgggcattttgcagatcaggacggctggcagaaggtgcttgatgacgtggctgtgctggcggcagacattcgtgatcgtcatcccggccgcccgctgattctggccggacacagcatgggcagctttatcgcgctggccagcgcggagcagtggccggacagctttgatggtctgattctgtgcggcagtgactacaagccgtcctggttgtggcgactcactttgttgccggtaaaactggaacgctggcgttgtggcccacggggccatagcgcactgatcaaggccctgagctttgatgcctttgcccgccagatccgcggacggcgcactgaatttgactggttaagccgggatgcggagcaggtggatcgctatattgctgccccctggtgcggacatgactgcagcacccagctctggcacgacctgatcggcgccatggtgaccgtggatggaaacaaggcgctgcgccagctacctgcgcggctgccagtgatgctgattggtggtgacagcgaccccatgagtggcaatggcaagggcatgccggctctttatcgcgccctgcaccgggctggcattgccgatctggcactggggttgttcagcgacggacgtcatgaaattctgaacgatctctgtcgcgaggcagtacacgaagatctgctcggctggctggcggagcgcttctga

SEQ ID NO: 58 - protein, 305 aa, Unknown
  Obtained from an environmental sample.
MTTDVLPAPDGHAIFLHRWLAPGECRGTVLWLHGMAEHGARYAPLADALNANGWNLYCPDHRGHGGSVRDESLRGHFADQDGWQKVLDDVAVLAADIRDRHPGRPLILAGHSMGSFIALASAEQWPDSFDGLILCGSDYKPSWLWRLTLLPVKLERWRCGPRGHSALIKALSFDAFARQIRGRRTEFDWLSRDAEQVDRYIAAPWCGHDCSTQLWHDLIGAMVTVDGNKALRQLPARLPVMLIGGDSDPMSGNGKGMPALYRALHRAGIADLALGLFSDGRHEILNDLCREAVHEDLLGWLAERF

SEQ ID NO: 59 - DNA, 1005 bp, Unknown
  Obtained from an environmental sample.
atgtttaaaataaatcggattttattctcagtctttgtcgccatcatgtgttttatggttgcaccggcacaagcagatagttcaggaatagatagatcaggaaaaacaaaatacccggtagttttagtacatggcctttcaggttttgacagcgtgtttgcagattatttttatggcgtaaaaggcgcgttagccagtgttggttctaccgaggtatatacaccactgattacgggatttaatacgagtgaagtacgtggagagcaattgctgagttatctggaggatttgaaagcggtcaccggtgcgcaaaaatttaacctaataggccattctcaaggtggtatcgatgcacgttacgtggcttccgttcgaccagacttagtcgcgtcggttacttctgttggttctccccattttggctctggcactgcagatttagttaaagattcgccactcgaaggtgcagctatggatataggtaatgctgtgggtgcacttttagcggctgttaccggggatacatcgcagcaggtagatgccatgggggctcttgaagcattaaattcagcggatgcggcggttttcaatgctaaatatcctgaagggttacgtcagggggattgtcaggaaacccctcgttataatgccggttcttggtggtggccaaattgggtttatgattactctgttaatgatggtgagcacaacgtaaatggtgtggcttattactcatggggaggaacttacaaccctgtgtttaattcaaatgtgctggatctggctgatggtttgttagcggcagcctatttgactatcgatgagtcaaacgatggtgtcgttggccgctgctcaacgcatctgggccaggttattcgtgatgactataccatgaatcacgcagacgagataaatggaatgtttggtttacgtggtttgggtacaacgagcccattacctttatatgtggagcatgcaagacgtctgactcgtgcgggtttgtaa

SEQ ID NO: 60 - protein, 334 aa, Unknown
  Obtained from an environmental sample.
MFKINRILFSVFVAIMCFMVAPAQADSSGIDRSGKTKYPVVLVHGLSGFDSVFADYFYGVKGALASVGSTEVYTPLITGFNTSEVRGEQLLSYLEDLKAVTGAQKFNLIGHSQGGIDARYVASVRPDLVASVTSVGSPHFGSGTADLVKDSPLEGAAMDIGNAVGALLAAVTGDTSQQVDAMGALEALNSADAAVFNAKYPEGLRQGDCQETPRYNAGSWWWPNWVYDYSVNDGEHNVNGVAYYSWGGTYNPVFNSNVLDLADGLLAAAYLTIDESNDGVVGRCSTHLGQVIRDDYTMNHADEINGMFGLRGLGTTSPLPLYVEHARRLTRAGL

SEQ ID NO: 61 - DNA, 861 bp, Unknown
  Obtained from an environmental sample.
atgaaacagaaattgaatgcagttcgttggttgtcgcccctgttgggattttttgccctgatcatggccgattccgtgtcggcattcagtggcccaagttccgggggcggcggtggggatggtggtttgggcggcggagtgggggcggcacctgtggactatgcccgctctggcagtttcagtgtgacgtccgagcgcggcggcagccagtgcacggtttaccggcccagcaacctcaccggcaatcacgcggtgatcatttggggtaatggcacaggctcatcacccacggcctacgccagcctgttgcggcattgggcgtcctggggctttgtcgtggtggcggccaataccggcagcgccggttcaggtcaggcgatgatcggctgcctggattggttggagtcttcgtcgctgcgctctgccatcaaccgcgacagggttggcacctcggggcattcccagggcggcggcggcgcgatcatggcggccaccgatcggcgcatcaccgcttctgcccctatccagggatacaccgtggggctgggccacagttcgacttcgcactcgcgtcagagcggccccatgctgctgttgtccggcagttccgacactttggtgtcgccacgtctcaatcacgccccggtgttcaaccgcgccaatgtgccggtgttctgggccaacctgcgcggcgccagccattttgagcccacccgcgatggcggtggttacaggggcattaccacggcctggttcctgtatcagttgaacgccgatgcccgcgccgcgcgtgaatttgaaggcgccagctgcggttactgcggcaaccgcagttgggaagtgcagcgcaaaggtttttga

SEQ ID NO: 62 - protein, 286 aa, Unknown
  Obtained from an environmental sample.
MKQKLNAVRWLSPLLGFFALIMADSVSAFSGPSSGGGGGDGGLGGGVGAAPVDYARSGSFSVTSERGGSQCTVYRPSNLTGNHAVIIWGNGTGSSPTAYASLLRHWASWGFVVVAANTGSAGSGQAMIGCLDWLESSSLRSAINRDRVGTSGHSQGGGGAIMAATDRRITASAPIQGYTVGLGHSSTSHSRQSGPMLLLSGSSDTLVSPRLNHAPVFNRANVPVFWANLRGASHFEPTRDGGGYRGITTAWFLYQLNADARAAREFEGASCGYCGNRSWEVQRKGF

SEQ ID NO: 63 - DNA, 1290 bp, Unknown
  Obtained from an environmental sample.
atgcgacgtggatttttccgtggcgcggccgctgcatgcgcggccgtgctggtgggcctgtcggcctgcaccccgctgcccgtgcaggcggccaacaacgacccggtggtgctggtgcacggcttcgccggcttcgggcgcggcgagatgctgggctacaagtactggggcggcctcaccgaccttcagcagacgctcaagggccgctacagcaaccagccggtggtcactgcggtggtggggccgttcagctccaactgggaccgcgcggtcgaactcttctaccagatcaagggcggctgcgtcgactacggcgagcagcattcgcaccagcacggccacctgcgcaagcccgaggaccacttccgcaacggccgcacctgctaccccggcctgcaccgcgactggagcgccgacaagccggtgcacatcgtctcgcacagcatgggcggccagaccgcccgcatgctggtgcagctgctggccggcaacggcgcccccgccaaccccaacctgttcgccggccacgccaccagcgcggcctgggtcaagagcgtcaccaccatcgccacgcccaacgacggcaccacgctggcctaccgcgtggtggactgggtgccggtggtgcagcagctggtcaccggcgtcgccggcctggccaacgccaccggcgccaaccgcatctacgacttcaagatggaccagtggtggatcggcccgcagaccgccggcgaaaccttcgaccagtacgtgcggcgggtcatgacctcgccggtgtggagcagcggcatcaccgacctgtcgccctacgacctgagcccggccggcgcgatggccgccaaccactgggtgaaggaccaccccggcgtcacctacttctcggtgagcaccgacggcagcgagcgcggctgggtgaccggatggtcctacccgcggctggataccaacccgctgatcgggctgttcgccggccccggctggatgggcaactacacccgtgaccaccggccgatgccgccggtggccgacagcagctggtggcccagcgacgcggtggtgaacaccgcggcgcagaaagcgcccacctgggccatggacccgcagggccgtgtctatgcccggccggtggtggtgcgcgacctgcgcagcggcggcacgccccagcgcggcgcctggaactggctgggcctgatggacggcttcgaccacttcgacatcaccggctggacgctgttctgggacagcacgggttggtacaaggcgcacatcgaccgcttgcgggcgctgtag

SEQ ID NO: 64 - protein, 429 aa, Unknown
  Obtained from an environmental sample.
MRRGFFRGAAAACAAVLVGLSACTPLPVQAANNDPVVLVHGFAGFGRGEMLGYKYWGGLTDLQQTLKGRYSNQPVVTAVVGPFSSNWDRAVELFYQIKGGCVDYGEQHSHQHGHLRKPEDHFRNGRTCYPGLHRDWSADKPVHIVSHSMGGQTARMLVQLLAGNGAPANPNLFAGHATSAAWVKSVTTIATPNDGTTLAYRVVDWVPVVQQLVTGVAGLANATGANRIYDFKMDQWWIGPQTAGETFDQYVRRVMTSPVWSSGITDLSPYDLSPAGAMAANHWVKDHPGVTYFSVSTDGSERGWVTGWSYPRLDTNPLIGLFAGPGWMGNYTRDHRPMPPVADSSWWPSDAVVNTAAQKAPTWAMDPQGRVYARPVVVRDLRSGGTPQRGAWNWLGLMDGFDHFDITGWTLFWDSTGWYKAHIDRLRAL

SEQ ID NO: 65 - DNA, 1488 bp, Unknown
  Obtained from an environmental sample.
atgccttattcagcgacattatcagtcaacaccttacttaataaagcagtaaggacactaaaccttacgtctttagctcaagaaaaacgtcagcattcatctgttaactcatcaaataactccttagagaatgttgaaaaagagccattacagataaatactttgcaaataagcactgacgataggcaatcctgcattgatagcgagcccctatccattagagataaagtactgcatcacaatttgctgacgacctatcagccccatttgctgcactatgcaatgaaaagtatcggtctcttgccagagacggtattagacaatctggtcggttatctagatggacctacggctaagcaatatgaacatgttgatgcgcacctgcgcttgattctggcggtgaatagtaagcttaaaactcctttacagctctcagagatgggcgagctgcggaaacgctttgctactgatgctgttgctatgcaaacgccaagagtgtggcaacaggcaagctcttcgttatttgacacgataaaaccttttaccaagaaaaatgagcctagcgtcaattgggaagataagacgattgccaatgcggatgatggcgatatgctggttcgttgttatcaaaagcaagtaaacgcagcaggctttagttttaaaaagaaagccaaacgcaatcctgatgaaaccgtcatgctatttttccatggcggtggtttttgtatcggcgacatcaacacccatcacgagttttgtcatgccgtctgtgagcgaacaggatggccagtggtcagtgttgattatcgcctagcacctgaatatcctgcgcctacgggactaagagattgtattgccgcttatgcttggttggcggataattgctataaatttggggcattagcatcgcgtattgttttggcaggagatagtgcgggcggcggcttatcaaccatgattgcccaacaagtcatcacgccgtctgcaaagtcatggcaagatttaggcgttgatgggcaaaaaacgtttgagatattacagcgcctgccgcagccactggcacaaatgcctttatatcccgtaacggatatcgaaaatgattatccaagctgggagctatacggcgaagggttattgctcgatcatgccgatgtggcagtttttgatgcggcttgtttagaaaatagtccgctgccgcgtcaacatatcttgacgtcgcctatgctcggtgacaatcgccacatttgcccgacctatgtcgttgcagcagaattggacgttttacgtgatgaggcgtttgcatatgccaagcagttagaggattatggtagagctgtccaaacttatacggtctatggtgcgccgcatggctttattcatcttatgagcgtgcaccaaggacttgagcagcaaaccaatcatattattcatggctttgctggctttgtacgtgacgtcatcagtacacaaaatttattagcagcctaa

SEQ ID NO: 66 - protein, 495 aa, Unknown
  Obtained from an environmental sample.
MPYSATLSVNTLLNKAVRTLNLTSLAQEKRQHSSVNSSNNSLENVEKEPLQINTLQISTDDRQSCIDSEPLSIRDKVLHHNLLTTYQPHLLHYAMKSIGLLPETVLDNLVGYLDGPTAKQYEHVDAHLRLILAVNSKLKTPLQLSEMGELRKRFATDAVAMQTPRVWQQASSSLFDTIKPFTKKNEPSVNWEDKTIANADDGDMLVRCYQKQVNAAGFSFKKKAKRNPDETVMLFFHGGGFCIGDINTHHEFCHAVCERTGWPVVSVDYRLAPEYPAPTGLRDCIAAYAWLADNCYKFGALASRIVLAGDSAGGGLSTMIAQQVITPSAKSWQDLGVDGQKTFEILQRLPQPLAQMPLYPVTDIENDYPSWELYGEGLLLDHADVAVFDAACLENSPLPRQHILTSPMLGDNRHICPTYVVAAELDVLRDEAFAYAKQLEDYGRAVQTYTVYGAPHGFIHLMSVHQGLEQQTNHIIHGFAGFVRDVISTQNLLAA

SEQ ID NO: 67 - DNA, 753 bp, Unknown
  Obtained from an environmental sample.
atgaaaaagtataaaacaggcctggttttaagtggtggcggaacacgtggttttgcgcatctgggagtgatagcagctctttacgataagggaattaaacccgacataatttcgggtacaagtgctggtgccattgttggcgcttttattgctgccgggaaaaatccacacgacgttgtggagatttttaaaaagggatcgtttttcaattacacaaaactacagataccccgcgacggtttgatgaaactggatggactgaaggaattgtttcaaaaggaaattcatgtaaaaaacctcgaagagcttgaaatccccctttttattgccatttcgaatttaaataaaggaaccgtggaatacagaaatagcggtcttttgggtgaaactgtgcttgcctcatcttcgatccccatactttttgctccggttttaatcggcgacgatttgtatgttgacgggggattaatggataacattccggttgaacccatcaaactcgattgtgaacaaatcattgtttcaaatatcagtccgattaatcccgttgaaaaaattaaaaatctgattcacattgctactcgtactttttatatgagtgtaaacgccaacatgaaacaggttaaaaaatattccacccattatattgaaccggacggaatagatacttacgaaattttaagccgcacccacgccgatgagttgtatgaacttggatataattcgacaattaaaatcctgaattcgcactaa

SEQ ID NO: 68 - protein, 250 aa, Unknown
  Obtained from an environmental sample.
MKKYKTGLVLSGGGTRGFAHLGVIAALYDKGIKPDIISGTSAGAIVGAFIAAGKNPHDVVEIFKKGSFFNYTKLQIPRDGLMKLDGLKELFQKEIHVKNLEELEIPLFIAISNLNKGTVEYRNSGLLGETVLASSSIPILFAPVLIGDDLYVDGGLMDNIPVEPIKLDCEQIIVSNISPINPVEKIKNLIHIATRTFYMSVNANMKQVKKYSTHYIEPDGIDTYEILSRTHADELYELGYNSTIKILNSH

SEQ ID NO: 69 - DNA, 783 bp, Unknown
  Obtained from an environmental sample.
atgtcagctgaaaaatataaattcggtcttgtcttaagtggtggcggtgcaagaggttttgctcaccttggagtaattgaggccttaaatgaagccggaatatatcctgatataatttccggaaccagcgccggcgctctggccggagtcttatatgctgacggatatactccaaaggaaatcctgaaaatgatgaatgccggcagccgcctcgactttatgcgtccggctttaccacgtgaaggactgctgcagattggcggtgtaatgaaaatactcagaagcaacttacgggcaaaaacttttgaggagctgaaaataccattgtttgtctctgcaacagacctgaataatggaaaagctgagtatttttcggaaggagatttgtttgatccggttatggcatctgcaagtattccggttctttttcaaccggtagttatcaacagtatttgctatgttgatggcggtgttcttgataacctccctctgcgcccgattgaaaataagtgcagtttcctgatcggttcttttgtaaaccccgttggctacctggaaaaaataagcggattgataagtatcgctgaaaggacttttatgctaagcatgtcaaaagaaattatcgaaaaatctaaaagatttgatctttttgttgctccgcaggaattaatgaattttaaaattctcgatccggataaagcagaggagctcttttcggtcggatataatgcaacaaaggaaaagcttgcagaaattgatgtcaagcaacttataaatgaataa

SEQ ID NO: 70 - protein, 260 aa, Unknown
  Obtained from an environmental sample.
MSAEKYKFGLVLSGGGARGFAHLGVIEALNEAGIYPDIISGTSAGALAGVLYADGYTPKEILKMMNAGSRLDFMRPALPREGLLQIGGVMKILRSNLRAKTFEELKIPLFVSATDLNNGKAEYFSEGDLFDPVMASASIPVLFQPVVINSICYVDGGVLDNLPLRPIENKCSFLIGSFVNPVGYLEKISGLISIAERTFMLSMSKEIIEKSKRFDLFVAPQELMNFKILDPDKAEELFSVGYNATKEKLAEIDVKQLINE

SEQ ID NO: 71 - DNA, 750 bp, Unknown
  Obtained from an environmental sample.
atgaaaaaatataaaacaggtttggttttaagtggcggaggaacccgtggatttgctcatttgggagcaattgcggcccttttcgataaaggaataaaacccgatgtaatttcaggaaccagcgccggggctattgcaggcgcttttattgccgccgggaaaaatccgcacgatatacttgaaacatttaaaaagggatcgtttttcaattacacgaagctccagattccgcgcgatggattaatgaaactggatggcttaaaagaattatttcaccgtgagattcctgccaaaaatctcgaagaacttgacatcccattttttgtgaccatttcaaatctaaataaaggtacagttgaatacagaaataccgggccgctgggagaaactgtacttgcctcatcgtcgattcccattctttttgcaccggttttaatcggcaccgatttgtacgttgacggcggattactcgataatattccgatagagcctataaaacacgactgtgatcaaattatcgtttccaatatcagcccgataaatccaacagataaaataaaaaacctgattgaaattgcaacgcgcactttttacatgagtgtgaacgccaatatgaaagaggttcgaaaatacgccggtatttatattgaacctgaaggaattgacaaatacgaaattttaagccgcacccatgccgatgaattgtttgaactggggtacagttcgacacataaaatactgattctttga

SEQ ID NO: 72 - protein, 249 aa, Unknown
  Obtained from an environmental sample.
MKKYKTGLVLSGGGTRGFAHLGAIAALFDKGIKPDVISGTSAGAIAGAFIAAGKNPHDILETFKKGSFFNYTKLQIPRDGLMKLDGLKELFHREIPAKNLEELDIPFFVTISNLNKGTVEYRNTGPLGETVLASSSIPILFAPVLIGTDLYVDGGLLDNIPIEPIKHDCDQIIVSNISPINPTDKIKNLIEIATRTFYMSVNANMKEVRKYAGIYIEPEGIDKYEILSRTHADELFELGYSSTHKILIL

SEQ ID NO: 73 - DNA, 1026 bp, Unknown
  Obtained from an environmental sample.
atgaaaaaatggcttgtttgtttattggggttaatggcactgacagtgcaagcggcagaggggcgtcagcctttttcccgggtcgtgatgtttggtgacagcctctccgacaccggcaagatgtacaagaagatgagggggtatctcccctccagcccgccctacttcaatgggcgtttcagcaacgggccggtctggctggagctgctgcgtgaccagcattttcccggactgctattggccaacgaggcagagggtggggcaacggcggtagcctacaacaagctgggctggcgcaatatttgggcttgggaccccaaatatcaggttatcaacaatctcgattacgagatcgatcagttcctgaaaaaggacaagttccgccccgatgatctggtggtgatctgggttggtgccaatgactatctggcttatggctggaacaaagaacaggatgcggatcgggtgatcgataccatcagattggcatccaaccggttggtgctcaacggtgcgcggcagatcctgctgttcaacatcccggatttggggcaagccccgtccgcccgcagcatgaaggtggtggataaggtgcgtcatgtcgccagctatcataaccagcggctgcagaacctcactcgcgagctggctcccctcggcatcgtgaagttgtttgaggtggacaagcagtttgacgagatggtgcaagacccgcagaaatttggtctgagcgataccgagcacgcctgttttgacggtggttatatgtggaagccgttctcaggcagcgatgctgaagttgctgcggcccctgctttgagcctgccagagaaggtggccatcgcaggtaacccacttttggcgcaggcggtgatgggcccgcaggcaaaagagcgcgcagcgaccctcaactgcaaggaacacatgttctgggatcaggttcatcccaccaaaactgtgcacaaggcattgagccagcgcgtggctgattttatcgaacaaaactacgagttcatccgtcattga

SEQ ID NO: 74 - protein, 341 aa, Unknown
  Obtained from an environmental sample.
MKKWLVCLLGLMALTVQAAEGRQPFSRVVMFGDSLSDTGKMYKKMRGYLPSSPPYFNGRFSNGPVWLELLRDQHFPGLLLANEAEGGATAVAYNKLGWRNIWAWDPKYQVINNLDYEIDQFLKKDKFRPDDLVVIWVGANDYLAYGWNKEQDADRVIDTIRLASNRLVLNGARQILLFNIPDLGQAPSARSMKVVDKVRHVASYHNQRLQNLTRELAPLGIVKLFEVDKQFDEMVQDPQKFGLSDTEHACFDGGYMWKPFSGSDAEVAAAPALSLPEKVAIAGNPLLAQAVMGPQAKERAATLNCKEHMFWDQVHPTKTVHKALSQRVADFIEQNYEFIRH

SEQ ID NO: 75 - DNA, 849 bp, Unknown
  Obtained from an environmental sample.
atgctggacatcaaacttagcggcattgccgctgcactgggcctggcgatctgcgggtctgccttggctgcgccgctgccggatacgcccggcgcgccctttcctgcggtatcgaacttcgagcgctctggcccctacgccacgaccagtcgcagcgaaggcccgaactgccgcgtctaccgtcccagtagcttggggcagaacggcgtccggcatccggtaattctctggggtaacggtaccgggaccgggccgaccgcgtattcgggactgttatcgcactgggccagccacggattcgttgtcgcagcggcggagacgtccaacgccgggactggacgggacatgctggcctgcctcgactacctggtacaagagagcaatcgcacctatggcacttacgttggcgtgcttaacaccggtcgggtcggcacgtcaggtcattcccagggcggcggcggatcgatcatggctgggcaggatgatcgggtgagcgtgaccgcgccaatccagccctacaccatcgggctgggtcatgacccgtcgtcgcagcgaaatcagaaggggccgatgtttttgatgtcaggcgggggcgacaccatcgcgtttccgtacctcaacgcgcagccggtctacacacgggccaatgtgccggtgttctggggtgagcggcgatatgtcagtcacttcgagccggtcggcgacggtggagcctaccgcggaccctcaacggcgtggttccgctatcacctgatggatgatgaaacggcgcgcagcaccttctatggtcgcttctgcgggttgtgcaccagctatctttggaccgagcagcgcaagggaatcgagtaa

SEQ ID NO: 76 - protein, 282 aa, Unknown
  Obtained from an environmental sample.
MLDIKLSGIAAALGLAICGSALAAPLPDTPGAPFPAVSNFERSGPYATTSRSEGPNCRVYRPSSLGQNGVRHPVILWGNGTGTGPTAYSGLLSHWASHGFVVAAAETSNAGTGRDMLACLDYLVQESNRTYGTYVGVLNTGRVGTSGHSQGGGGSIMAGQDDRVSVTAPIQPYTIGLGHDPSSQRNQKGPMFLMSGGGDTIAFPYLNAQPVYTRANVPVFWGERRYVSHFEPVGDGGAYRGPSTAWFRYHLMDDETARSTFYGRFCGLCTSYLWTEQRKGIE

SEQ ID NO: 77 - DNA, 1413 bp, Unknown
  Obtained from an environmental sample.
atgggtatcttcgattacaaaaacttcggacccgagggttccaaggcgttgttcgccgacgctatggcaatcaccttgtacagctatcacaacctggataacggctttgccgtgggttaccagcacaacggcctgggctggggtttgcccgccactttggtcggcgcggtgctcggtggcagcgattcccaaggggtgattccaggcatcccgtggaatccggattcggaaaaggccgccctggatgccgtgcaaaaggccgggtggacgcccataagcgccagcgtcctgggctacgtcggcaaggttgatgcgcggggcacattctttggggaaaaggccggctacaccacggcgcaagtcgaggtgctgggcaagtacgatgacgcgggcaaattgctcgaaatcggcatcggctttcgcggtacgtccgggccacgggaaagcctgatcagcgactccatcggcgatttggtcagtgacctgctggccgcgctggggcccaaggattatgcgaagaactacgccggtgaggcatttggcgggctgctgaaaaatgttgccgactacgccagtgcccatggcctgcacggcgccgatgtgctggtcagcggtcatagcctgggcggcctggcggtcaacagcatggccgacttgagcggcagtcagtggtcagggttctacaaggacgccaactacgtagcctacgcctcgccgacccaaagcagcggcgacaaggtgctcaatatcggctacgaaaatgacccggtgttccgcgcgctggacggctcatcgttcaacctgtcgtcccttggcgtgcatgacaagccccatgagtcgagcaccgacaatatcgtcagcttcaacgaccactacgcctcgaccctgtggaatgtgctgccgttttccatcaccaacctgccgacctggatctcccatctgcccaccgggtatggcgacgggctgacacgggtcgttgaatcgggtttctacgagcagatgacccgcgattccacggtcatcgtcgccaacctgtccgacccggcacgcgccaccacctgggtgcaggacctcaaccgcaacgccgaaccgcacaagggcaataccttcatcattggcagcgacggcaacgacctgatccagggcggcaagggcgcggactttatcgagggtggcaagggcaatgacacgattcgcgacagcagtgggcacaatacctttctgttcagcgggcagtttggccaggaccgggtgatcggctatcaggcgacggacacgctgctgttcaaggatgtgcagggcaatgtgcaataccgggagcagggtggagacacgctgatcagtgtcggcgcggagtcggtgacattggtgggcgtgcacggcttttcgggggaggggattgtgatcagctaa

SEQ ID NO: 78 - protein, 470 aa, Unknown
  Obtained from an environmental sample.
MGIFDYKNFGPEGSKALFADAMAITLYSYHNLDNGFAVGYQHNGLGWGLPATLVGAVLGGSDSQGVIPGIPWNPDSEKAALDAVQKAGWTPISASVLGYVGKVDARGTFFGEKAGYTTAQVEVLGKYDDAGKLLEIGIGFRGTSGPRESLISDSIGDLVSDLLAALGPKDYAKNYAGEAFGGLLKNVADYASAHGLHGADVLVSGHSLGGLAVNSMADLSGSQWSGFYKDANYVAYASPTQSSGDKVLNIGYENDPVFRALDGSSFNLSSLGVHDKPHESSTDNIVSFNDHYASTLWNVLPFSITNLPTWISHLPTGYGDGLTRVVESGFYEQMTRDSTVIVANLSDPARATTWVQDLNRNAEPHKGNTFIIGSDGNDLIQGGKGADFIEGGKGNDTIRDSSGHNTFLFSGQFGQDRVIGYQATDTLLFKDVQGNVQYREQGGDTLISVGAESVTLVGVHGFSGEGIVIS

SEQ ID NO: 79 - DNA, 912 bp, Unknown
  Obtained from an environmental sample.
atgaaaaaatggctattggtgctgctgtgcgccctgcccatgctgggccaggcggcaggttatacccagacccgctaccccatagtgctggtgcacggcctgttcggcttcgacaagctgctcggggtcgactacttctacggcatcccccaggcactgacccgggatggtgccagggtctatgtggcccaggtctccgccacccagagctcggaactgcgcggcgagcagttgctcaaacaggtgcagcaagtgctggccatcacgggagcggagaaggtgaacctcatcggccactcccacggcggccccaccattcgctatgtcgcctcggtcgcccccgagctggtcgcctccgccaccagcgtgggcggggtcaactacggctcggagatcgccgatctggtgcgcgccaacgtggcaccgggctcggtggccgagaagctggcggtggcggctgcctccgccctgtccggggtcatctcgctgctctccgggggcagccagctgccgcaggatcccctcgccgccctcgacgccctcaccagcgccggcgcccaacgcttcaaccagcgctaccctgaggggctgcccagccagtactgcggcgaagggcccatgcaggccgccaacggggtctactacttctcctggagcgggcgcggcaccatgaccaacatcctggatccggtggatccggcgctggcgttgaccagcagcttcttcaaggagcccaacgatggcctggtcggggtgtgcagcagccacctcggcaaggtgatcggcaccgactaccggatgaaccacctggacgaggtgaaccagtcgttcggcattcgccacctgtttgagaccgacccggtcagcctctatcgccagcacgccaaccgcctgcagagactggggttatga

SEQ ID NO: 80 - protein, 303 aa, Unknown
  Obtained from an environmental sample.
MKKWLLVLLCALPMLGQAAGYTQTRYPIVLVHGLFGFDKLLGVDYFYGIPQALTRDGARVYVAQVSATQSSELRGEQLLKQVQQVLAITGAEKVNLIGHSHGGPTIRYVASVAPELVASATSVGGVNYGSEIADLVRANVAPGSVAEKLAVAAASALSGVISLLSGGSQLPQDPLAALDALTSAGAQRFNQRYPEGLPSQYCGEGPMQAANGVYYFSWSGRGTMTNILDPVDPALALTSSFFKEPNDGLVGVCSSHLGKVIGTDYRMNHLDEVNQSFGIRHLFETDPVSLYRQHANRLQRLGL

SEQ ID NO: 81 - DNA, 984 bp, Unknown
  Obtained from an environmental sample.
atgaaaataaaacacattctaggctcgctggtgacagcgctatgtctaacatctacgacaacttatgctactcaagctcaacagatcaaagtctcaagtgtcaaatctgattatgccaaaacgaaatatcctattgtattcgctcatggaatggtcggatttatacgtttgggcactgaaagtctaggcatggattactggtatcaaattttacctgatctagcgagaaacggtgcaaacacatgggcggctaggatgtctcctttcaattcttctgaagtccgaggtgaacaatatgttcaacaacttgaagaagtcatggcgattactggtgctgacaaactcaatctgattggtcatagtcatggtgcaaactctgttcgttatgccgcaggtgtaatgcctgaacatgttgcatcggtgatgactgtagccggtgccaacaaaggtacaatcatcgcgtcagatgtattaaaaatcgcagataaaacaggaacatctgagctactgaatgttctcatcagcacttttggtaaagtcattatgtgggcgcaaggtcttcctgctgatacgttcccacatgatgcgatggccgctggtgtgagtacatctgttgaaggaactgccttgtttaatcaaaaattccctctcggtttaccattaacccactgtggcgaaggtgcttatcaagaaaaaggaattcatttatattcaatgacaggaaacaagccttttacgaatgccttggatctaggtgaccctgtcatggttctacttgaccgtttgtcggttcataaagcaggaaaaaatgatggcatcgttccagtttgtagtgcccattttggtaaaactattcgtgatgactttccgtggaatcatttagatgaggtgaacttgctgttcggaattaaaggattttttgctcctgacccagttgcagtttatagacagcacgccaaccgccttaaattacaaggactttaa

SEQ ID NO: 82 - protein, 327 aa, Unknown
  Obtained from an environmental sample.
MKIKHILGSLVTALCLTSTTTYATQAQQIKVSSVKSDYAKTKYPIVFAHGMVGFIRLGTESLGMDYWYQILPDLARNGANTWAARMSPFNSSEVRGEQYVQQLEEVMAITGADKLNLIGHSHGANSVRYAAGVMPEHVASVMTVAGANKGTIIASDVLKIADKTGTSELLNVLISTFGKVIMWAQGLPADTFPHDAMAAGVSTSVEGTALFNQKFPLGLPLTHCGEGAYQEKGIHLYSMTGNKPFTNALDLGDPVMVLLDRLSVHKAGKNDGIVPVCSAHFGKTIRDDFPWNHLDEVNLLFGIKGFFAPDPVAVYRQHANRLKLQGL

SEQ ID NO: 83 - DNA, 624 bp, Unknown
  Obtained from an environmental sample.
atgaagaagcttttcatgctggcgttgctggcatccatgctgtttgccggccctgccaaagcctgcaatgcagaccctatcgttttcattcatggttattccggctggaaatcccagtttgatgtcatgatcaaccgcttcaggaatgacggcacacccgcctgtgcgatgtacaagttcggttataacagccttggcaatagcaacaagaccagcgccaggcaactgagaaatttcatcaataacattcgtcccaatcacaacaaccgcagggccaacatcatcgcccactccaatggtggcttggtctcccgttggtaccgcgtgtttgagggtggttcttcagccaccaatcgtctggtgacactcggcacccctcatcaaggcaccgcttgggcctatggctgtttcagccccgcctgctttgaaatgcgttataactcgtcgttcctgcaagatctgaatgggcgcggttgtgatgtgtccctgtggtcggcacttgatgagattatcatcccgcagtccaacgcccaatgcggcaacagtcgtcggacatccagtgtggggcatttgacgctgatgatctggaaaggcgtctatgatgatgtaaggcgctacctttaa

SEQ ID NO: 84 - protein, 207 aa, Unknown
  Obtained from an environmental sample.
MKKLFMLALLASMLFAGPAKACNADPIVFIHGYSGWKSQFDVMINRFRNDGTPACAMYKFGYNSLGNSNKTSARQLRNFINNIRPNHNNRRANIIAHSNGGLVSRWYRVFEGGSSATNRLVTLGTPHQGTAWAYGCFSPACFEMRYNSSFLQDLNGRGCDVSLWSALDEIIIPQSNAQCGNSRRTSSVGHLTLMIWKGVYDDVRRYL

SEQ ID NO: 85 - DNA, 987 bp, Unknown
  Obtained from an environmental sample.
atgaaaaacttaaaacttaaattgatacctacgacgttagcattcgtcacaacgctatgcttatcaagctcattcactgcccacgcaggtccgggattactcgaagtaaatgagacaaagatcggtagttatgcaaaaaccaaatatcctattgtgatgacacacggttggttaggctggtctcgcataggcaatgaaacattcaatattgactattggtatcaaatcttacctgatctatcgcgcaatggtgcacgcgtttttgcagcacaactctcacctgctcatacgactgaatttcgaggagaacaattaatttctcaggttgaagaagtaattgcgattactgggcagaaaaaggtcaatctgattggtcattcgcacggcggaccgactgtgcgttatgttgcagcagtaaaacccgactatgttgcttctgttactggtgtaggagggactttcagaggttctatggtcgcagataaaattcaaaataatgaagcaactcgaacaatatttaatattttaggggattacatcattcccccattaattgcttatgcacaaggtcgtcctgatatgccgatcagctttgatgcttcgatgaaatcattaactgaaacaggctctgctgcatttaatcaacgttttccaacaaaagctctcgcgtcaagttgtactcgtttaggcagcccaatagacaacggaatcttttattattcttggactggtgttgcacaaaccaccaacctcttagacatcgataccattttaatgcagctagggcctttagcgtatggcaataaagataatgatggcatggttgggcgctgtagcacgcatattggacgtgtgattcgtgatgattacaaactaaatcataccgatttagctaatatgatgttcggtctcaaaggtttatttgccccagatcctatttcactttatcgccagcatgccaatcgtttgaaactgacaggactctag

SEQ ID NO: 86 - protein, 328 aa, Unknown
  Obtained from an environmental sample.
MKNLKLKLIPTTLAFVTTLCLSSSFTAHAGPGLLEVNETKIGSYAKTKYPIVMTHGWLGWSRIGNETFNIDYWYQILPDLSRNGARVFAAQLSPAHTTEFRGEQLISQVEEVIAITGQKKVNLIGHSHGGPTVRYVAAVKPDYVASVTGVGGTFRGSMVADKIQNNEATRTIFNILGDYIIPPLIAYAQGRPDMPISFDASMKSLTETGSAAFNQRFPTKALASSCTRLGSPIDNGIFYYSWTGVAQTTNLLDIDTILMQLGPLAYGNKDNDGMVGRCSTHIGRVIRDDYKLNHTDLANMMFGLKGLFAPDPISLYRQHANRLKLTGL

SEQ ID NO: 87 - DNA, 1854 bp, Unknown
  Obtained from an environmental sample.
atgggtgtgtacgactacaaaaacttcggtacagccgattccaaagcgttatttaccgacgcgatggcgatcacgctgtattcctatcacaacctggataacggctttgccaccggctatcagcacaacggcttcggccttggcttgccggcgacactggtgaccgcactgatcggcggcgccgactcccagggcgtcattcccggaatcccatggaaccccgattcggaaaaagccgcactggacgcggtgcagaaagccgggtggacaccgatcaccgccacgcaactgggctatgacggcaaggtcgacgcacgcggaacgttcttcggcgaaaagaccgggtacaccagcgctcaggtggaaatcctcggcaagtacgacgcgcagggtcatctcagcgaaatcggtatcgcctttcgcggtaccagcggcccacgggaaagtcagatcagcgactccatcggcgatgtgatcaacgatctgctggcagcactagggcccaaggattatgcgaaaaattacgtcggcgaagccttcggtaatctgctgagcgacgtcgcggcgtttgcccaggctaatggcctgtcgggcaaggacgtgctggtcagcggccatagcctcggcgggttggcggtcaacagcctggcggatttgagcagcggcaagtggaacgggttctaccaggattccaactacatcgcctacgcctcgccgacccaaagcagcaccgataaagtgctgaacgtcggttacgaaaacgacccggtgttccgcgccctcgatggctcctcgttcaacctgtcgtcggtgggcgtgcacgatgccgccaaggtttcgacgaccgataacatcgtcagcttcaacgaccactacgcctcgacggcgtggaatgtgctgccgttttcgatcctcaatataccgacgtggatctcgcacttgccgaccgcctatggcgacggcatgaaccgggtgatcgagtcgaagttctacgacctcaccagtaaagactcgacgatcatcgttgctaacctgtcggatccggcgcgcgccaacacgtgggttcaggacctgaatcgcaacgctgaaacccacaagggcagcacgttcatcatcggcagtgacggcaacgacctgatccagggtggacggggcaacgactatctggaaggccgcgatggcaacgacaccttccgcgacggtggtggctacaacatcttgctgggtggcaagggcaacaacgtgctggatgtgcagcagtcggtgaagaacttcgacttcgccaatgacggcgccggcaacctgtacatccgcgacgccaatggcggcatcagcatgacccgcgacattggcagcattgtgaccaaggaaccgggggttctgtgggggctgttcaaggatgacgtgactcacagcgtcacggccgaaggccttaaggcgggcaacaacgttacccaatacgcgtcaacggtaaagggcggcgccggtgccgatacgctcaaggcacacgctggcggcgattggctgtttggactggacggcaacgaccatttgatcggcagcaccggtaacgacgtgtttgtcggcggggcgggcaatgacgtgttggagtcggggggcgggatcgatacgttcctgtttagcggcgcgtttggtcaggaccgggtggttggctaccaggccagcgataaactggtgtttctcggggttcagggggtgacgccgaacgacgactatcgggcgcatgccacggcggtggggcacgacacggtgctgacgtttgggggggattcggtgacgttggtcggggttgggctggatagcttgtccggctcaggggttgttatcgcctga

SEQ ID NO: 88 - protein, 617 aa, Unknown
  Obtained from an environmental sample.
MGVYDYKNFGTADSKALFTDAMAITLYSYHNLDNGFATGYQHNGFGLGLPATLVTALIGGADSQGVIPGIPWNPDSEKAALDAVQKAGWTPITATQLGYDGKVDARGTFFGEKTGYTSAQVEILGKYDAQGHLSEIGIAFRGTSGPRESQISDSIGDVINDLLAALGPKDYAKNYVGEAFGNLLSDVAAFAQANGLSGKDVLVSGHSLGGLAVNSLADLSSGKWNGFYQDSNYIAYASPTQSSTDKVLNVGYENDPVFRALDGSSFNLSSVGVHDAAKVSTTDNIVSFNDHYASTAWNVLPFSILNIPTWISHLPTAYGDGMNRVIESKFYDLTSKDSTIIVANLSDPARANTWVQDLNRNAETHKGSTFIIGSDGNDLIQGGRGNDYLEGRDGNDTFRDGGGYNILLGGKGNNVLDVQQSVKNFDFANDGAGNLYIRDANGGISMTRDIGSIVTKEPGVLWGLFKDDVTHSVTAEGLKAGNNVTQYASTVKGGAGADTLKAHAGGDWLFGLDGNDHLIGSTGNDVFVGGAGNDVLESGGGIDTFLFSGAFGQDRVVGYQASDKLVFLGVQGVTPNDDYRAHATAVGHDTVLTFGGDSVTLVGVGLDSLSGSGVVIA

SEQ ID NO: 89 - DNA, 1101 bp, Unknown
  Obtained from an environmental sample.
atgtcgaaatcgaagggttatcgcattgttgcctgggcgatcgctgctgctgttgccaacgcgccgctcgtcgtactcctgacacttgccacgccggccggaatcgatcgcgcggttgccgcgacatcgaataccgccagcgacgattacgcggcaacacgctatccgatcatcctcgtacatggccttaccggcaccgacaagtacctcggcgtactcgactactggtacggcattcagtcagacctccagcagcacggtgccaccgtgtacgtggcgaacctttcgggttttcaaagcgacgacggtccgaatggccgtggcgaacagttgctcgcttacgcgaagcaggttctggcggcaaccggtgcgcagaaggtaaacctgatcggtcacagccagggcggcttgacgtcgcgctatgtcgcggcggtcgcgccggaactcgtcgcttcggtgaccaccatcggcacgccgcatcgcggttcggagttcgccgacttcgtgcaggacgcgttgaaaaaagacccgaccggtctttcgacgccgatcatcggcgcctttgcgaatatcttcggcatcctgacgagtagcagtcacaacaccaaccagaacgcggtagccgcgctgcaaacgctgaccacagcgaacgccgccgcctacaacctgcgctatccgagcgcgggtctcggcgcaccgggttcgtgtcaaaccggcgcggcgactgaaaccgtcaacggcaacacgcatctgttgtattcgtgggcgggcagcgcgattcaatccacgtcgatactgggcattccaggtgctaccgacaccagtgtcgcgccgctcgacgccgctaacgtcctcgatccgtcgacgctcgttttatacggcaccggcgccatcatgctgagccgacagtcggggcagaacgacggcctcgtctcggtgtgcagcgcgctctacggcaaggtgctcagtaccagctacaagtggaatcacctcgacgaaatcaaccagttgctcggcgtacgcggcgcgaatgcagcggatcccgacagcctcaagcgggcttatcggcgcatggcgcgtcagtaccaccccgacatcaac

SEQ ID NO: 90 - protein, 367 aa, Unknown
  Obtained from an environmental sample.
MSKSKGYRIVAWAIAAAVANAPLVVLLTLATPAGIDRAVAATSNTASDDYAATRYPIILVHGLTGTDKYLGVLDYWYGIQSDLQQHGATVYVANLSGFQSDDGPNGRGEQLLAYAKQVLAATGAQKVNLIGHSQGGLTSRYVAAVAPELVASVTTIGTPHRGSEFADFVQDALKKDPTGLSTPIIGAFANIFGILTSSSHNTNQNAVAALQTLTTANAAAYNLRYPSAGLGAPGSCQTGAATETVNGNTHLLYSWAGSAIQSTSILGIPGATDTSVAPLDAANVLDPSTLVLYGTGAIMLSRQSGQNDGLVSVCSALYGKVLSTSYKWNHLDEINQLLGVRGANAADPDSLKRAYRRMARQYHPDIN

SEQ ID NO: 91 - DNA, 1425 bp, Unknown
  Obtained from an environmental sample.
atgggtgtgtttgactataaaaaccttggggccgagggctccaaagccttgtttgccgatgccatggcgatcacgttgtatacctaccacaacctggataacggctttgccgtgggctaccagcacaatggcttgggcgtcggcttgccggccactctggtcggcgcattgctcggcagtacggactcccagggagtgatcccaggcattccctggaacccggattcggagaaggccgcgctcgaagcggtgcagaaggctgggtggacgcccatcagcgccagcaccctcgggtataccggcaaggtcgacgcccggggcacgttcttcggcgaaaaggccggctataccacggcccaggtcgaggtgctgggcaagtacgatgacgcgggccagttgcaggaaatcggcatcggttttcgcggcacgtctggcccaagggaaacactgatcaccgactccatcggtgatctggtcagcgacctgcttgcggcgctgggtcccaaggattacgcgaagaactacgccggcgaagcattcggcggcttgctcaagaacgtcgccgagtatgcggcggcccacggtctgagcggccaggatgtgctggtcagcggccatagcctcggcggcctggcggtcaacagcatggccgacttgagcgacgccaagtggtccgggttctataaggacgccaactacttggcctacgcctcaccgacccagagtgccagcgacaaggtgcttaatatcggctacgaaaacgacccggtgttccgcgctttggacggctcatccgccaacctgtcgacgctcggggttcacgacaaaccccacgagtccaccactgacaacattgtcagcttcaacgatcactacgcctcgaccctgtggaatgtgctgccgttttccatcgccaatctgccgacctggatctcgcacttgccgaccggctacggcgacggcatggggcgcattctggagtcagggttctatgaacagatgaaccgggactcgacgattatcgtggccaatctatccgacccggcacgggccaccacttgggtgcaggacttgaaccgcaacgccgaaccgcacacaggcgacacttttatcattggcagcgatggcgatgatctgatccagggcggcaagggcgcggactttatcgaaggcggcaagggcaatgacacgatccgcgacagcagcgggcataacacctttttgttcaacggccagtttgggcaggatcgaattatcggttatcagccgacggataaactcgtgttcgagggtgtggcgggcagcgcggattaccgtgatcacgccaaggtggtgggtggggatacggtgatcagtttcggggcggattcggtgacgttagtgggcgttagcggggtgttgggggagggggttgtgatcggctga

SEQ ID NO: 92 - protein, 474 aa, Unknown
  Obtained from an environmental sample.
MGVFDYKNLGAEGSKALFADAMAITLYTYHNLDNGFAVGYQHNGLGVGLPATLVGALLGSTDSQGVIPGIPWNPDSEKAALEAVQKAGWTPISASTLGYTGKVDARGTFFGEKAGYTTAQVEVLGKYDDAGQLQEIGIGFRGTSGPRETLITDSIGDLVSDLLAALGPKDYAKNYAGEAFGGLLKNVAEYAAAHGLSGQDVLVSGHSLGGLAVNSMADLSDAKWSGFYKDANYLAYASPTQSASDKVLNIGYENDPVFRALDGSSANLSTLGVHDKPHESTTDNIVSFNDHYASTLWNVLPFSIANLPTWISHLPTGYGDGMGRILESGFYEQMNRDSTIIVANLSDPARATTWVQDLNRNAEPHTGDTFIIGSDGDDLIQGGKGADFIEGGKGNDTIRDSSGHNTFLFNGQFGQDRIIGYQPTDKLVFEGVAGSADYRDHAKVVGGDTVISFGADSVTLVGVSGVLGEGVVIG

SEQ ID NO: 93 - DNA, 1272 bp, Unknown
  Obtained from an environmental sample.
atgagacgttcgagcacatggcggcgcgtcctgggcgccgcggtgttgtgggtgggtgcagtgcttccggccttcgcggccaatacatacccggtgatcctggtgcacggcttcgccggcttcggccgcagcgagatgctgggctacaagtactggggcggactgaccgacctgcaggtgcagctgcagggccgctaccccgaccagctggtgcgcaccgcggtggtcgggcccttcagctccaactgggaccgcgcggccgagctgttctaccagatcaagggcggctgcgtggactacggccagatgcacgcgaacaacgcgggccacctgcgcaagccggaagacttcttccacaacgggcggacgtgcttccccggcctttacccgcaatgggatgcgaaccacccggttcacctggtctcgcacagcatgggcggccagaccgcgcgcatgctggtccagatgctcgcggccaacggcgcgccggccaacccgggcctgttcccgtattcggtgaacgccaactgggtgcgcagcgtcaccacgatctcgacgccgaacgacggcaccacgctggcctaccgcatcgtggactgggtgccggtggtgcagcagctggtgaccggcttcgccggcatcgccagcgcgacgggcgccgacaagatctatgacttcaagatggaccagtggaagatcggcgcgcagttgccgaccgagaccttctcggcctacatgaagcgggtgatgagctggccgctgtgggacagcggcatcaccgacctctcgacttacgacctgggccccaacggcgccatggccgagaacgactgggtgaaggaccagcccaacgtctactacttctcgtacagcaccaacgcgagctacagcggcctgtggggatggtcgtacccgacgatcgacgccaacccgctgatcggcgccttcgccgggccgggcttcatgggcaactacacccacgacagccgtcccttcccgccggtgtccgacagcagctactggcccagcgacgcggtggtgaacaccgccgcgcagaaggcgccgacctgggcgatgcactccacgggcgtcgtgtacccgcggccggtgacggtgcgcgacctgagccacggcggcacgccgcaggccggcgcgtggaactggaagggcaacatgcccgactacgaccacttcgacatcatcggctggacgctgttcttcgacagcgtcggctggtacaagtcgcacgtggaccagttgcggggcctgtga

SEQ ID NO: 94 - protein, 423 aa, Unknown
  Obtained from an environmental sample.
MRRSSTWRRVLGAAVLWVGAVLPAFAANTYPVILVHGFAGFGRSEMLGYKYWGGLTDLQVQLQGRYPDQLVRTAVVGPFSSNWDRAAELFYQIKGGCVDYGQMHANNAGHLRKPEDFFHNGRTCFPGLYPQWDANHPVHLVSHSMGGQTARMLVQMLAANGAPANPGLFPYSVNANWVRSVTTISTPNDGTTLAYRIVDWVPVVQQLVTGFAGIASATGADKIYDFKMDQWKIGAQLPTETFSAYMKRVMSWPLWDSGITDLSTYDLGPNGAMAENDWVKDQPNVYYFSYSTNASYSGLWGWSYPTIDANPLIGAFAGPGFMGNYTHDSRPFPPVSDSSYWPSDAVVNTAAQKAPTWAMHSTGVVYPRPVTVRDLSHGGTPQAGAWNWKGNMPDYDHFDIIGWTLFFDSVGWYKSHVDQLRGL

SEQ ID NO: 95 - DNA, 657 bp, Unknown
  Obtained from an environmental sample.
atggtggcgcgaaaacttcctgcacaggcggtcactaagcgctatgggcttcagaccactgcctatggtgaatggctggacatgccgggggttgaatcccggaagactattttatatctgcccggtggcgcgtttctcgtgcgtatgcccaatgcgcaccggcaattggtcggtcgtctgtgtaccgcgattcaggccaatgcggcaatcgtccactatcgtctcgctccggaaaacctttttccggcggcactggaagatgcattgaagacctaccgtcagttacttgccaatggctccgctcccgaagacatcatcctgatgggcgattcggcaggtggcggtttggctctatctacagcactggccttgcgtgacgccggagaacccatgccgtcagggatcgttgttatgtcgccattggcggacttgacctactcaggtgagtcacgccagcgccataggtggaaggacccgctgttgccggtctcaaggaaccagggagatgcacgttactatttgggtaaccatgacccgtcagacccactggcttcacccatttttggcgactattccgacctaccccctatcctgttgcagacaggatcattccgaaagatcgcgagcgagcccaggacaacgtcaccaaaatattga

SEQ ID NO: 96 - protein, 218 aa, Unknown
  Obtained from an environmental sample.
MVARKLPAQAVTKRYGLQTTAYGEWLDMPGVESRKTILYLPGGAFLVRMPNAHRQLVGRLCTAIQANAAIVHYRLAPENLFPAALEDALKTYRQLLANGSAPEDIILMGDSAGGGLALSTALALRDAGEPMPSGIVVMSPLADLTYSGESRQRHRWKDPLLPVSRNQGDARYYLGNHDPSDPLASPIFGDYSDLPPILLQTGSFRKIASEPRTTSPKY

SEQ ID NO: 97 - DNA, 1854 bp, Unknown
  Obtained from an environmental sample.
atgggtgtgtttgactacaagaacttcactgcaagtgactccaaggcgctgttttccgatgcgctggcgatcaccctgtactcctaccacaacatcgacaacggctttgccgagggctaccagcacaacggcttcggcctgggcctgccggcgaccctggtcacggcgctgatcggcagcggcaattcccagggggtaatccccggcattccctggaaccccgactccgagaaggccgcgctggatgccctgcaccaggccggctggtccaccatcagcgcccagcaactgggctacgacggcaaggtcgatggccggggaaccttctttggcgagaaggccggctacggcacggcccaggtggaaatcctcggcaagtacgatgcccagggccacctggagtccatcggcattgcctttcgcggcaccagcgggccacgggaatcggtgatcagtgacaccatcggtgatgtgatcaacgacctgctggcggccctggggcccaaggactatgcgaagaactatgccggcgaggcgttcggcaagttgctgggagatgtcgccgcctttgcccaggccaatggcctgtcgggcaaggatgtcctggtcagcggccacagcctgggcgggctgggggtcaacagcctggcggacctgagcagcgaacgctggtcggggttctacaaggactccaactacatcgcctacgcctcgccgacccagagcgccagcgacaaggtgctgaacatcggctacgagaacgacccggtgttccgcgccctggacggctcaaccttcaacctgtcgtccctcggggtgcatgacgcccaccaggactcggcgaccaacaacatcgtcaacttcaacgaccattacgcctcgaccctgtggaatgtgctgccgttctcgatcctcaacattcccacctggctctcccacctgcccaccggctacggcgacggcctgtcccgggtgctggaatcgaagttctacgacttcaccagcaaggactccaccatcgtggtagccaacctgtcggacccggcccgggccagtacctgggtccaggacctcaaccgcaatgccgagacccacaagggcagcaccttcatcatcggcagcgacggcaacgacctgatccagggcggcagcggcaacgactacctggaaggccgggccggcaacgatacgttccgcgacagcggcggctacaacatcatcctcggcggccagggcagcaacaccctggacctgcagcagtcggtcaagaactacagctttgccagcgacggcgccgggaccctgtacctgcgtgacgccaatggcggtatcagcatgacccgcgacattggcgcgatccagagcaaggagccgggctttctctggggcctgttcaaggatgatgtgatccaccaggtcaccgaccagggcctcaaggccggcgggcagcttacccagtacgcctcgtcggtcaggggcgatgcgggcgacaacgtgctcaaggcccatgccggcggcgactggctgttcggcctggacggcaacgaccacctgatcggcggccagggcaacgacgtgttcgttggcggtgccggcaacgacctgatggaagccggaggcggcaacaatacctttctgttcaccgggcatttcggccaggaccgcatcctcggctaccagggtggcgacaagctggtgttcatgggggtgagcggcgtgctgccggaccaggactatcgggctcatgccagcagcagtggtaacgacacggtgctgaccttcggccaggactcggtgaccctggtgggggtcagcctggagcacctcaacggttccggcatcgttctcgcctga

SEQ ID NO: 98 - protein, 617 aa, Unknown
  Obtained from an environmental sample.
MGVFDYKNFTASDSKALFSDALAITLYSYHNIDNGFAEGYQHNGFGLGLPATLVTALIGSGNSQGVIPGIPWNPDSEKAALDALHQAGWSTISAQQLGYDGKVDGRGTFFGEKAGYGTAQVEILGKYDAQGHLESIGIAFRGTSGPRESVISDTIGDVINDLLAALGPKDYAKNYAGEAFGKLLGDVAAFAQANGLSGKDVLVSGHSLGGLGVNSLADLSSERWSGFYKDSNYIAYASPTQSASDKVLNIGYENDPVFRALDGSTFNLSSLGVHDAHQDSATNNIVNFNDHYASTLWNVLPFSILNIPTWLSHLPTGYGDGLSRVLESKFYDFTSKDSTIVVANLSDPARASTWVQDLNRNAETHKGSTFIIGSDGNDLIQGGSGNDYLEGRAGNDTFRDSGGYNIILGGQGSNTLDLQQSVKNYSFASDGAGTLYLRDANGGISMTRDIGAIQSKEPGFLWGLFKDDVIHQVTDQGLKAGGQLTQYASSVRGDAGDNVLKAHAGGDWLFGLDGNDHLIGGQGNDVFVGGAGNDLMEAGGGNNTFLFTGHFGQDRILGYQGGDKLVFMGVSGVLPDQDYRAHASSSGNDTVLTFGQDSVTLVGVSLEHLNGSGIVLA

SEQ ID NO: 99 - DNA, 876 bp, Bacteria
atgtatattgacggtgtgttttccggcggaggagtaaaaggcattgcgctcgcaggcgcttatgaagtgcttgaggaaaaaggcttccgctttaaaagagttgcgggtacaagcgccggcgccattattgccgctttcattgcgtcaggttacaccagtaaggaaatccatgctttaattgaagaagtggacggagagaaattgctggatcagaggtactcatttctccccttaaagatgctccagtgggtgtccatctactggcgtcttggcttatacaaaggcgatacgatagaaaaatggattgctgatctgttaagagcgaaaggcataagggttttcggcgatttgcagaaagggtctctgcgccttattgcttctgatctgacaaacggcaccatgattgttttgccggacgatttggcccgttacgggttaaatccagatatgttcccggttgccagagcggtcagaatgagctgcagcattccgtatttctttgaaccgataaaattaaaaacggacacaggcaccgccacggttgtcgacggaggcgtgttaagcaattttccaatctggctgttttcaaaggaaagaaagcgccctgtgatcggtgtcacgcttgcgccgcgtgaaagagagcgtccgaaaaaaaatatccgcaacgcttttgaactgttcggcgccctgtttgaaacgatgaaggatgctcatgacgcaaggcacattgcgtcacgctatgaacaaaatatcatttttctccctgttgatgacgtaatggccactgattttcatttaacacaacaaaaaaaactagccctgattgagctaggtaaaagacggacagagctgtttttaaagcagtggacctattaa

SEQ ID NO: 100 - protein, 291 aa, Bacteria
MYIDGVFSGGGVKGIALAGAYEVLEEKGFRFKRVAGTSAGAIIAAFIASGYTSKEIHALIEEVDGEKLLDQRYSFLPLKMLQWVSIYWRLGLYKGDTIEKWIADLLRAKGIRVFGDLQKGSLRLIASDLTNGTMIVLPDDLARYGLNPDMFPVARAVRMSCSIPYFFEPIKLKTDTGTATVVDGGVLSNFPIWLFSKERKRPVIGVTLAPRERERPKKNIRNAFELFGALFETMKDAHDARHIASRYEQNIIFLPVDDVMATDFHLTQQKKLALIELGKRRTELFLKQWTY

SEQ ID NO: 101 - DNA, 675 bp, Unknown
  Obtained from an environmental sample.
atgaatcaagccctggaaaccatcgagatcgcgaccggtgacgcacccggcgcgagcatcatctggctgcatggactcggcgccgacggcaatgacttcgtgccgatcgtcgaggagctcgatctgccccgcggcgtggacattcgcttcgtgttcccgcacgcgccgatgattccggtcaccgcgaacggcggttatgtgatgcgcgcctggtacgacatcaacctcgatggccccgaacggcggccggacgcggtcggtctgcgcgcctcgggcgcggcgatcgaacaactcctagcgcgcgagcgcgaacgtggcatcgcggcggaacgcatcgtgttggccggcttttcccagggcggcgccgtgacgctgcagaccggtctgcgccactccgaacgcctcgccggattgatggtgctgtcgagctatctgccgctgcccgaaacggtggcggccgaagcggctccggcgaacgcgccggtgccgatcttcttcgcgcatggtcagtacgatccggtgatcccgatccagcgcgcagaacgctcgcgtgttcatctggagcaactcggctacgcggtcgaatggcacagctacccgatgcagcactcgttgtgcgcccagcagatcgtcgatatcgggcgttggttgcagaaagtgctgcctgcgtcctga

SEQ ID NO: 102 - protein, 224 aa, Unknown
  Obtained from an environmental sample.
MNQALETIEIATGDAPGASIIWLHGLGADGNDFVPIVEELDLPRGVDIRFVFPHAPMIPVTANGGYVMRAWYDINLDGPERRPDAVGLRASGAAIEQLLARERERGIAAERIVLAGFSQGGAVTLQTGLRHSERLAGLMVLSSYLPLPETVAAEAAPANAPVPIFFAHGQYDPVIPIQRAERSRVHLEQLGYAVEWHSYPMQHSLCAQQIVDIGRWLQKVLPAS

SEQ ID NO: 103 - DNA, 786 bp, Unknown
  Obtained from an environmental sample.
atgggcgacccgattgtgcttgtgcacggtattttagggttcaaccagatagttgtcggcggtacgaatgtcacgacgtactttcgtgacattcgcgacgctcttatcgaagacggtcatactgtgcccgtgccgccacggctcgatccgactggctccattaagaaacgcgcacacgacctcaagggatatctggagacaaacggagacgttagcggtcgccgggtgcatcttgtggcgcacagtatgggcggccttgattcacgatttctgatttccagactcggcatggaaaaccgggtgttgtcgctgacgacgattggcactccgcaccacggaagtccgatcgcggatttcgtgatgtcgcatacgcatccggcgttggcctcggtttttgaattattgggtgtgcaaggcgttgatgatttgacgagccacagctgtgaacagttcaatcaggattgccccgagtctccgcgcgtgcgctatcgctcggtgggaggaagctatcagccagacagcgtacttgtggcgccgtttgaaatcctgaggctgactcgcgacctgatgcaaaaggattttggagacaacgacgggttggtcccgctcgagtcggcgaagtttggctcggatgcgacgaggtgggaatatcgcggagcttggcctgcaaatcacttccggctggtcaactggggcacgaatatcgcaataactccgaaagaatgtggagacaattggatcgtcgacaaataccgtgagcttgtggcagatatcgtgcaaccttag

SEQ ID NO: 104 - protein, 261 aa, Unknown
  Obtained from an environmental sample.
MGDPIVLVHGILGFNQIVVGGTNVTTYFRDIRDALIEDGHTVPVPPRLDPTGSIKKRAHDLKGYLETNGDVSGRRVHLVAHSMGGLDSRFLISRLGMENRVLSLTTIGTPHHGSPIADFVMSHTHPALASVFELLGVQGVDDLTSHSCEQFNQDCPESPRVRYRSVGGSYQPDSVLVAPFEILRLTRDLMQKDFGDNDGLVPLESAKFGSDATRWEYRGAWPANHFRLVNWGTNIAITPKECGDNWIVDKYRELVADIVQP

SEQ ID NO: 105 - DNA, 1854 bp, Unknown
  Obtained from an environmental sample.
atgggtgtgtatgactacaagaacttcggcacagccgactccaaggcactgttcagcgatgccatggcgatcacgctgtattcctatcacaacctcgacaacggttttgccgctggctatcagcacaacggtttcggtatcggcctgcccgccaccctggtcaccgcgctgattggcggcaccgattcacaaggcgtgatccccggtattccatggaatcccgactcggaaaaactcgccctcgatgcggtaaaagcggctggctggacgccgatcaccgcctcgcaactgggctacgccggcaagaccgatgcccgcggaaccttctttggcgagaaggccggctacaccagcgctcaggttgaaatcctcggcaaatacgacgcccaggggcatctcacggaattaggcatcgccttccgtggcaccagcggcccgcgagaaatcctcatcggcgactcgattggcgatgtgatcaacgatctgctcgccgcgtttggtcccaaggattacgcgaagaattacgtcggtgaagcattcggcaacctgctcaatgacgtcatggcgtttgccaaggccaacggcctgaccggcaaagacgtgttgatcagcggccacagcctcggcggattggcggtcaacagcatggcggatttgagtggcggcaagtggggcggcttcttcgctgactccaactacatcgcctacgcctcgcccacacaaagcagcaccgacaaagtcctcaatgtcggctacgaaaatgacccggtgtttcgtgcgcttgacggctcgaccttcaccggcgcctcggtcggcgtgcacgacgcaccgcacgcctcgaccaccgacaacatcgtcagcttcaacgaccactacgcctcaaccgcgtggaacctgctgccgtactcgatcctgaatattccgacgtggatttcgcacctgccgaccgcttatggcgacggcatgaaccgggtcatcgaatcgaagttctacgacctgaccagccgcgactcgacgattattgtcgccaacctgtccgacccggcgcgcgccaacacctgggtgcaggatctcaaccgcaacgccgacccgcacaagggcagcacgttcatcatcggcagcgatggcaacgacctgatccagggcggcagcggcaatgactatctcgaaggccgcgccggcaacgacagcttccgcgacggcggcggttacaacatcattctgggcgggcagggcagcaataccctcgatttgcagaagtcggtcaacacgtttgactttgccaatgatggcgccggcaatctgtacatccgcgatgccaatggcgggatcagcatcacccgtgacatcggcagcatcgtcaccaaggagccggggttcctctggggtctgttcaaggatgacgtcacccacagcgtgaccgcgagcggtttgaaagtcggcaacaacctcaccgcttacgaatccagcgtcaaaggcagcagcggtgccgacacgctcaaggcgcacgccggcggcgactggttgtttggcctcgacggcaacgatcacctgattggcggcagcggcaacgacgtgtttgtcggcggcgccggcaatgacttgatggaatcggggggcggggcggacacgttcctgttcaacggtgcgttcgggcaggatcgagtgctcgggttcacgtccaacgacaaactggtgttcctcggtgtgcagggcgtgttgccgaccgacgacttccgcgcccatgcctcgacggtagggcaggatacggtgctgacgttcggcaatgattcagtgacgctggtcggggtttcgctcaacagcctgagcgccgacggcatcgtcatcgcctga

SEQ ID NO: 106 - protein, 617 aa, Unknown
  Obtained from an environmental sample.
MGVYDYKNFGTADSKALFSDAMAITLYSYHNLDNGFAAGYQHNGFGIGLPATLVTALIGGTDSQGVIPGIPWNPDSEKLALDAVKAAGWTPITASQLGYAGKTDARGTFFGEKAGYTSAQVEILGKYDAQGHLTELGIAFRGTSGPREILIGDSIGDVINDLLAAFGPKDYAKNYVGEAFGNLLNDVMAFAKANGLTGKDVLISGHSLGGLAVNSMADLSGGKWGGFFADSNYIAYASPTQSSTDKVLNVGYENDPVFRALDGSTFTGASVGVHDAPHASTTDNIVSFNDHYASTAWNLLPYSILNIPTWISHLPTAYGDGMNRVIESKFYDLTSRDSTIIVANLSDPARANTWVQDLNRNADPHKGSTFIIGSDGNDLIQGGSGNDYLEGRAGNDSFRDGGGYNIILGGQGSNTLDLQKSVNTFDFANDGAGNLYIRDANGGISITRDIGSIVTKEPGFLWGLFKDDVTHSVTASGLKVGNNLTAYESSVKGSSGADTLKAHAGGDWLFGLDGNDHLIGGSGNDVFVGGAGNDLMESGGGADTFLFNGAFGQDRVLGFTSNDKLVFLGVQGVLPTDDFRAHASTVGQDTVLTFGNDSVTLVGVSLNSLSADGIVIA

SEQ ID NO: 107 - DNA, 861 bp, Unknown
  Obtained from an environmental sample.
atgaccagggtgtggcggcaccacgaccggaggtcactcgacgcccaattcatcctcgattcggtcccgaacctcgagagcctgttcgcccgtcggctcgagcggagtgcccgagcgcgggagcgcttccgaccgctgacggtccgctacggcgagggcccgggcgagacgctggacgtctacgccgcgggtacgcggacgcccgtgcaggtcttcatccacggcggcttctggcgctcgctcgatgccgcgaccttcgccttcctcgccgacgccttcgtccccgccggcgccatgctggtggtgatcgactacccgctgatccccgaggtcgagctcgctgccatcgtcgccgcctgcgagcgcgccatcgcctggaccttccgcaacgccgccgggcatggcggcgatccggggcgcatccacatctccggcaactcggccgggggacacctggtggcgctcttgatggaccgcgcctggccagcgcggcacggcctgcccggggacgtggtcgccggcggctgcgcgatcagcggcctcttcgacctcgagccggtgcgcctgagcgcccagaacgagacgctggcgctgaccgagcgcgaggtcgccgtgctcagcccgcttcgccgcctgccggcggccgccgggccgctgatcgtcgccgtcggcggcgccgagaccgaggagttccggcgccagagccgcgactacgcgcaggcttggcgcgccgccggcctcgcgggcgaggagctggtggtcccgggcgccaaccacatcgacatcgtcctcgaccatctcggcgaccggggctccccgctgcacgtcgccgtccgccgccagatgggcctcgccggctga

SEQ ID NO: 108 - protein, 286 aa, Unknown
  Obtained from an environmental sample.
MTRVWRHHDRRSLDAQFILDSVPNLESLFARRLERSARARERFRPLTVRYGEGPGETLDVYAAGTRTPVQVFIHGGFWRSLDAATFAFLADAFVPAGAMLVVIDYPLIPEVELAAIVAACERAIAWTFRNAAGHGGDPGRIHISGNSAGGHLVALLMDRAWPARHGLPGDVVAGGCAISGLFDLEPVRLSAQNETLALTEREVAVLSPLRRLPAAAGPLIVAVGGAETEEFRRQSRDYAQAWRAAGLAGEELVVPGANHIDIVLDHLGDRGSPLHVAVRRQMGLAG

SEQ ID NO: 109 - DNA, 1575 bp, Unknown
  Obtained from an environmental sample.
atgcgcaagatagtgctgctgttgatcctgctgaccgggctggcgcccaccgcctgggcggccacggtcaagaccacccaccgcaccattcccagctgggatggaacgcctctcggggccttcgtcatcgaaccgcaggacgcgggcagtggccgctatccgctgctggtgatgcccagcagctgggcagttccaagcgtggaatatgtgggcgtggcacagtcattggcgcgacgtggctacgtggtcatcagctacagttcgcgcggcttctgggaatcgggcggcgccatcgacattgccgggccggccacggtcgaagatgtcagcgccctgatcgactgggcgctggacaacacccaggctgatccgtcgcggatcggcgtctccggcatctcctacggcgccggcaccagcctgctggcggcggcgcgcgacccgcgcatcaaggcggtagcggccctgagcggttgggccgacctgcaggcttcgctgtacagcaacgacacccccagcgcacagggcatcgccctactggtggcggccgggctggccacgggccgcccaggtgcggagctggccacgatcaaccgcagcgtgctgctcggtaactaccagggtgcggtggactcgctgttgccggttgcggctcaacgcagccctggcgccagcatcgacgagatcaatgccaaccaaccggccgttttcctggccaacgccttcaacgacagcctgttcccgccgggccagctggtggatttcttcaatcgcctgaaggggcccaagcagctgcagctgcgccacggtgaccatgcgctcaacgaggccttcggggcgttgggtattcccaatgaggtctatgaccaggtgggggcgtggttcgatcactacctgaaaggcgcgtccaatgggatcgagcgccaggccgcagtgcagttgaagtcgcagaagggcagctggagccgctatccggactggcaggcaaccaacagtggtgccgtcagttacgggctgaccgcaccgggtggcctgctgctgcccaccggtggcctggcagagaacgggcgcactacgggatggaactatcgcatcggcagtggcctgctgacggccgccaactccggcatcgcgatggcgtctggcgcgctgcagatgatcaatctgccaccgggggcctatgtgccgttcgtgggacgcaatgccgccggtgtctggcaggggccgatctactggagcgcacggcgcctggatggtgcccccgaagtgcgcgtgaccgtcacccccagccgcgccaacaccacgctgtatgcctacctgtatgcggaagacgtgctgggcaatggccagctgatcagccacaagccctacacgctgcgcggtgccacgccgggccagccgaagacgctcgacctgcgcctggaagcaagcagctggaacattccggccggcagccgcctgaccctggtcgtcgatacggtggatctgcgctatgcgggcatcagccagctgggtggtgcggtgaccttcagttcgccggccaatgcaccttcggtattgaaggtgccgttgcattga

SEQ ID NO: 110 - protein, 524 aa, Unknown
  Obtained from an environmental sample.
MRKIVLLLILLTGLAPTAWAATVKTTHRTIPSWDGTPLGAFVIEPQDAGSGRYPLLVMPSSWAVPSVEYVGVAQSLARRGYVVISYSSRGFWESGGAIDIAGPATVEDVSALIDWALDNTQADPSRIGVSGISYGAGTSLLAAARDPRIKAVAALSGWADLQASLYSNDTPSAQGIALLVAAGLATGRPGAELATINRSVLLGNYQGAVDSLLPVAAQRSPGASIDEINANQPAVFLANAFNDSLFPPGQLVDFFNRLKGPKQLQLRHGDHALNEAFGALGIPNEVYDQVGAWFDHYLKGASNGIERQAAVQLKSQKGSWSRYPDWQATNSGAVSYGLTAPGGLLLPTGGLAENGRTTGWNYRIGSGLLTAANSGIAMASGALQMINLPPGAYVPFVGRNAAGVWQGPIYWSARRLDGAPEVRVTVTPSRANTTLYAYLYAEDVLGNGQLISHKPYTLRGATPGQPKTLDLRLEASSWNIPAGSRLTLVVDTVDLRYAGISQLGGAVTFSSPANAPSVLKVPLH

SEQ ID NO: 111 - DNA, 1851 bp, Unknown
  Obtained from an environmental sample.
atgcccgtattcgattaccgacagctcgacagcactgcctcctctgcgctgtacaaggacgccatggcgctggccacctacgcctaccatggcatcgacgacggcttcagcgccggctaccagaagtacggcttcggccttggcctgccagccacgctggtcaaggcgctgatcggcggcaccgacagccagggcgtgatccccggcatcccctggaaccccgactccgaagcgcgggccctggcccaggtcaaggccgccggctggtcgccgatcagcgcggcgcaactgggttaccagggcaagaccgacgcccgcggcaccttccacggcgaagcgccgggctacacctcggcgcaggtggagatcctcggccgctacgatgccgccggccagctcagtggcatcggcatcgcttttcgtggcaccagcggcccgcgcgagaacctgctgggcgacaccattggcgatgccatcaatgacctgctggcggcgatcggcccggcaggctatgcccgtgattacgccggcaacgcattcgggcaactgctcgccgatgtagcggcctttgccaaggccaacggtctgagcggcgcggatatcaccgtcagcggtcatagccttggcggcctggcggtcaacagcctggccgacctgagcggctcgcgctggggtggtttctatcaggatgcgcgctacgtcgccttcgcctcgccgacccaggccgccgacgccagcaaggtgctcaatatcggctacgagaacgacccggtgttccgcgcgctcgacggcacttcggcgacctggagcaccctgggcgtgcacgacggcgccaaggcctcggccaccaacaacatcgtcaacttcaatgaccactacgcgtccgatgcctggaacctgctgccgttctccatcggcaacatcgccacctggctgtcgcacctgccaacggcctacaccgacggccttgggcgtgtgctggactcatctttctatcagtggaccagccgcgactcgaccgtcgtggtcagcaacctgtccgacgtgacccgtggctcgacctgggtcgaagatctcaaccgcaacgccgagcagcacaagggcagcacgttcattatcggctcggacaaggacgacctgatccatggcgggcgcggcaacgactacctcgaaggccgggccggcaacgataccttccgcgatgacggcggtttcaacctgatcgacggcggcgccggccatgacaccctgaggctgcaggatgccctggccaacctgagcattgcccgggatggcgagggcacgttgtacgtgcgcgacgccgggggtggcatcagcctggtgcgcaatgtcgaaaacctggtgagcaaggagtcgagcctgctgatcttcagcaaggaagtcagtcacgcggtggcggcgcaggggctgttcgagagcggcaagatcaccccctatgcgtcctcgctcaacggcacccaggcaggcgaccagctggtagcgggaaatcagggccaatggctgttcggcctgggcggtgacgaccggctgcagggcggcgcgggcaatgacgtgctggttggcggcgcgggcaacgatgtgctgatgggtggcgctgggcgcgacaccttcctgttcagcggccatttcggccaggaccgggtgctggatttcaccggccaggatcggctggtgttcattggcgtggacggtggcaccgcagcgccggattggcgtgcccatgccagccaggtgggggaagacctggtgctgaagttcggcggggacagcgtgacgctggtggggattgcggggcagggggttggggatgggcagatcgtgattgcctga

SEQ ID NO: 112 - protein, 616 aa, Unknown
  Obtained from an environmental sample.
MPVFDYRQLDSTASSALYKDAMALATYAYHGIDDGFSAGYQKYGFGLGLPATLVKALIGGTDSQGVIPGIPWNPDSEARALAQVKAAGWSPISAAQLGYQGKTDARGTFHGEAPGYTSAQVEILGRYDAAGQLSGIGIAFRGTSGPRENLLGDTIGDAINDLLAAIGPAGYARDYAGNAFGQLLADVAAFAKANGLSGADITVSGHSLGGLAVNSLADLSGSRWGGFYQDARYVAFASPTQAADASKVLNIGYENDPVFRALDGTSATWSTLGVHDGAKASATNNIVNFNDHYASDAWNLLPFSIGNIATWLSHLPTAYTDGLGRVLDSSFYQWTSRDSTVVVSNLSDVTRGSTWVEDLNRNAEQHKGSTFIIGSDKDDLIHGGRGNDYLEGRAGNDTFRDDGGFNLIDGGAGHDTLRLQDALANLSIARDGEGTLYVRDAGGGISLVRNVENLVSKESSLLIFSKEVSHAVAAQGLFESGKITPYASSLNGTQAGDQLVAGNQGQWLFGLGGDDRLQGGAGNDVLVGGAGNDVLMGGAGRDTFLFSGHFGQDRVLDFTGQDRLVFIGVDGGTAAPDWRAHASQVGEDLVLKFGGDSVTLVGIAGQGVGDGQIVIA

SEQ ID NO: 113 - DNA, 915 bp, Unknown
  Obtained from an environmental sample.
atgacaaaacgcttctggaagtacctcgcggtctgcctgatcgccctgacctccctgcccgcgccatcctgggcggccggctacacgcaaaccaaatacccgatcgtgctggtgcacggcctgttcggcttcgacaacatcggcccggtcgactacttctacggcatcgcctcggggttgcgcagcggcggcgccaatgtgtatgtgacgtcggtgtcggccgccaacagcaccgaggtgcgcggcgagcagctgctggtgcaggtcaagcagatcctggccgcgaccggcgcttccaaggtcaacctgattggccatagccacggcggccccaccgcgcgttatgtggcgtcggtgcggccggacctggtggcttcggtcagcagcgtcggtggcgtcaacaagggctccagagtggccgatgtgctgatcggcgcggtgccggacgtgacctacagcctggccaacgcggtctccggatttatcagcttcctgtccggcagcccgaccttgccgcagaatgcgcgcgcggcggccacctcgctgagcaccgccggcacgctggccttcaacggcaggcatcccgaaggcgtgccgacgtcggcctgcggcgagggcgactaccaggtgcgcggcgtgtactacttctcgtggagcggcgcgcagccttacaccaatctgctggacgccagcgatccggtgctggccctgacggcgatcgccttcaacggcgccaagaacgatggcctggtcagcagctgctccagccacctgggccgggtgatccgcgacgactatgcgatgaaccatctggacgaagtgaatcagctggtgggcatcaccaacctgttcgagaccagcccggtgaccatcttccgccagcaggccaatcgcctgcagggactgggactgtaa

SEQ ID NO: 114 - protein, 304 aa, Unknown
  Obtained from an environmental sample.
MTKRFWKYLAVCLIALTSLPAPSWAAGYTQTKYPIVLVHGLFGFDNIGPVDYFYGIASGLRSGGANVYVTSVSAANSTEVRGEQLLVQVKQILAATGASKVNLIGHSHGGPTARYVASVRPDLVASVSSVGGVNKGSRVADVLIGAVPDVTYSLANAVSGFISFLSGSPTLPQNARAAATSLSTAGTLAFNGRHPEGVPTSACGEGDYQVRGVYYFSWSGAQPYTNLLDASDPVLALTAIAFNGAKNDGLVSSCSSHLGRVIRDDYAMNHLDEVNQLVGITNLFETSPVTIFRQQANRLQGLGL

SEQ ID NO: 115 - DNA, 705 bp, Unknown
  Obtained from an environmental sample.
atggtgaagcgtaggttgaaagtgcgcgccgcagcgtctcgcgcaccggcgctgactacggcattcggctcggccgtgctggccgcaaccctgttttcgctgcccttcccggcctttgcggccaacgcgccggaacaggccaggccggtgatcgtcgtgctcggcgacagcatctccgccgaatacggcttgccccgcgacactggctgggttgccctgatgcgccagcgtctcaccgacgagcgaatcgattatagcgttgccaacgcgagcatcagcggcgacaccacgagcggcggccgggcccgcttgccggcgcttctgcagcgcctcaagccgagcatcgtgatcgtcgagcttggcgccaacgatgccttgcgcggcgtgccgctcgccacgaccgaagacaatctgcgcacgatcatcgagcaggctcaacaaagccatgcgaaagtcgtgctggtcggcatgtatgtgccacccaattacggccccgactacacgcaaaagttccatggtctgtacggcgaactctcgaagcaattgcgagtgccgctagtgcctttcctgctcgccggcatcgccgacaaaccggacatgttccaggcggatcagatccatcccacgcagcaggcacagccaatgctactcaacaacgtgtggccggctgtcaagccactccttcgcacaagttcgccgcactga

SEQ ID NO: 116 - protein, 234 aa, Unknown
  Obtained from an environmental sample.
MVKRRLKVRAAASRAPALTTAFGSAVLAATLFSLPFPAFAANAPEQARPVIVVLGDSISAEYGLPRDTGWVALMRQRLTDERIDYSVANASISGDTTSGGRARLPALLQRLKPSIVIVELGANDALRGVPLATTEDNLRTIIEQAQQSHAKVVLVGMYVPPNYGPDYTQKFHGLYGELSKQLRVPLVPFLLAGIADKPDMFQADQIHPTQQAQPMLLNNVWPAVKPLLRTSSPH

SEQ ID NO: 117 - DNA, 1047 bp, Unknown
  Obtained from an environmental sample.
atgcgagcagtttgcgacgaggcacgtacgatacgtacggtacgtaccgtacgtattgcaattcttgctggaatgatttcactgcttgccgcatgcggcggtggaaacagttcgagtagcggcggcagcgcggccacgccaccgggcggcgtcaatctgcaagtcgtctcgttcggcgacagcctgtcggacgtcggcacttatgcgccgattgccagtgcggtcggcggcggacgtttcacgaccaatccggggcaagtgtgggatcaggacgtcgcgcaatattacggcggttcgctaagcgccgcgtttacgatcgacgtcggccatcagttgagcgcgcaaagcggtttcggctacgcagagggtggctcgacggtggccacgccggcgaacacgtacaattttctttccgacgtgatcggcaatgtcgaaatgccggtcaatcagcaggtttcgagctatctgaacgcgcacggaagcttcaattccaatcagttggtgctggtctgggccggcgcaaacgacgtgcttcgcgccggctcgctgccggccgcggcgccgaccgtgcagaccgcggcatccacgcttgcgcaactgattgggcagatcgttcagaacggcgccacgcatgtggtggtggtcaatgtgcccaacatcggcctgtcgcctaaaggcatcgcctcctccgacggcggagtcaatctgacccagttatcgcaacttttcaacgcggacctgaacacggccttgcaggccaacggcctgcaaggcaaggtcatccagatcgacgcttatacatgggtcggccagatcatcgcgaattatcaggccaacggcttcacggtgacgaacaccgcccaggcctgcgaccccaagaaaacgccggacgatacggcgttactgtgttcaccggcgacctacgtgacacccaatgccgaccagacctatatgttcgcggacgaccttcatccgaccacccatctgcatgcgctgttcgcccaatacgtagagcagcagatcgccaaaagcgggttaggtcactga

SEQ ID NO: 118 - protein, 348 aa, Unknown
  Obtained from an environmental sample.
MRAVCDEARTIRTVRTVRIAILAGMISLLAACGGGNSSSSGGSAATPPGGVNLQVVSFGDSLSDVGTYAPIASAVGGGRFTTNPGQVWDQDVAQYYGGSLSAAFTIDVGHQLSAQSGFGYAEGGSTVATPANTYNFLSDVIGNVEMPVNQQVSSYLNAHGSFNSNQLVLVWAGANDVLRAGSLPAAAPTVQTAASTLAQLIGQIVQNGATHVVVVNVPNIGLSPKGIASSDGGVNLTQLSQLFNADLNTALQANGLQGKVIQIDAYTWVGQIIANYQANGFTVTNTAQACDPKKTPDDTALLCSPATYVTPNADQTYMFADDLHPTTHLHALFAQYVEQQIAKSGLGH

SEQ ID NO: 119 - DNA, 1854 bp, Unknown
  Obtained from an environmental sample.
atgggtgtgtatgactacaagaatttcggtacggcggaatccaaggcgctgttcagcgacgccatggccattacgctgtattcctaccacaacctcgataacggcttcgccgtcggttatcagcacaacggcttcggcctcggcctgccggccacgctggtgaccgcgctgatcggtggcacggattcccagggggtaatccccggcattccgtggaaccccgattcggaaaaagccgcactcgacgcggtgcaaaaagccggatggaccccgatcaccgcctcgcagctgggttacgagggcaagaccgatgcccgcggcaccttcttcggcgaaaaggccggctacaccagcgcccaagtggaaatcctcggcaaatacgacgctcagggtcatctcaccgaaatcggcatcgcttttcgcggcaccagcggcccacgggaaatcctgatcggcgattccatcggtgacgtgatcaacgacttgctcgccgcattcgggcccaaggattacgccaagaactacgtcggcgaagccttcggcaacctgatgaacaatgtggtggcgttcgccaaggccaatggcctgaccggcaaagacgtgctggtcagcggtcacagcctcggcgggctggcggtcaacagcatggcggatttgagcacgagtaaatggggcgggttcttccaggactccaactacatcgcctacgcctcgccgacccagagcagcaccgacaaggtgctcaacgtcggctacgaaaacgatccggtgttccgcgccctcgacggctcgaccttcaccggcgcctcgctcggcgtgcacgacgcgccaaaggagtctgcgaccgacaacatcgtcagcttcaacgaccactacgcctcggcggcgtggaacgtgctgccgttttcgatcgtcaacattccgacctggatctcgcatctgccgaccgcttatggcgacggcatgaaccgggtgatcgagtcgaagttctacgacctgaccagcaaggactcgacgatcatcgtcgccaacctgtcggatccggcgcgggccaacacctgggtgcaggacctgaaccgcaacgccgaaacccacaagggcagcaccttcatcatcggcagcgacgccaatgacctgatccagggcggcagcggcaacgattatctggaaggccgcgccggcaacgacacgttccgcgacggcgggggctacaacatcctgctcggaggctcgggcaacaacaccctggagttgcagaagtcggtcaataccttcgacttcgccaacgacggcgccggcaacctgtacatccgcgatgccaacggcgggatcagcatcacccgtgacatcggcagcatcgtcaccaaggagccgggtttcctctggggtctgttcaaggacgacgtgacccacagcgtcacagcgaccggtctgaaggtcggcaacaacgtcacccagtacgaatcgagcgtgaagggcaccggcggcgccgacaccctcaaggccaaggctggcggtgactggctgttcggcctggacggcaacgaccatctgatcggcggggcgggcaacgacgtgttcgtcggcggcgccggcaatgacctgatggagtcgggcggcggggcggataccttcctgttcagcggcgcgttcggtcaggatcgcgtggtgggttacaccgctaacgacaaactggtgttcctcggcgtgcagggcgtgttgccaaacgacgacttccgcgcccatgccacggcggtggggcaggatacggtgctgaaattcggcgctgattcggtaacgctggtcggggttgcgttgaacagcctgagtgccgacgggattgtgatcgcctga

SEQ ID NO: 120 - protein, 617 aa, Unknown
  Obtained from an environmental sample.
MGVYDYKNFGTAESKALFSDAMAITLYSYHNLDNGFAVGYQHNGFGLGLPATLVTALIGGTDSQGVIPGIPWNPDSEKAALDAVQKAGWTPITASQLGYEGKTDARGTFFGEKAGYTSAQVEILGKYDAQGHLTEIGIAFRGTSGPREILIGDSIGDVINDLLAAFGPKDYAKNYVGEAFGNLMNNVVAFAKANGLTGKDVLVSGHSLGGLAVNSMADLSTSKWGGFFQDSNYIAYASPTQSSTDKVLNVGYENDPVFRALDGSTFTGASLGVHDAPKESATDNIVSFNDHYASAAWNVLPFSIVNIPTWISHLPTAYGDGMNRVIESKFYDLTSKDSTIIVANLSDPARANTWVQDLNRNAETHKGSTFIIGSDANDLIQGGSGNDYLEGRAGNDTFRDGGGYNILLGGSGNNTLELQKSVNTFDFANDGAGNLYIRDANGGISITRDIGSIVTKEPGFLWGLFKDDVTHSVTATGLKVGNNVTQYESSVKGTGGADTLKAKAGGDWLFGLDGNDHLIGGAGNDVFVGGAGNDLMESGGGADTFLFSGAFGQDRVVGYTANDKLVFLGVQGVLPNDDFRAHATAVGQDTVLKFGADSVTLVGVALNSLSADGIVIA

SEQ ID NO: 121 - DNA, 1413 bp, Unknown
  Obtained from an environmental sample.
atgggtgtgtttgattataaaaacgttggggccgagggctcaaaagcggtgttcgccgatgcgatggcgatcaccttgtatacctatcacaacctggataacggctttgccgtgggctatcagcacaacggactggggctgggtttaccggccacgttggtcggtgcgctgctcggcagcacggactcacagggcgtgatccccggtattccatggaaccccgactcggaaaaagctgcactggacgcggtgcagaaagccggttggacgcccatcagcgccggtaccctgggctatggcggcaaggtcgacgcgcgcggtacattctttggcgaaaaggccggctacaccacggcccaggtcgaagtgctgggcaggtacgatgacgccggcaagctgctggaaatcggtatcggctttcgcggcacgtccggcccgcgtgaaagcttgatcagcgattcgatcggcgatctggtcagtgacgtgcttgcggcgctggggcccagggattacgcgaaaaactacgccggtgaagcgttcggcggtttgctcaagagtgtcgccgagtatgccggcgcccagggcctgagcggcaaggatgtgctggtcagcggccacagcctgggcggcctggcggtgaacagcctggctgacttgagcgatgccaagtggggcgggttctacaaggacgccaattacgtggcctatgcctcgccaacccagagtgccggcgacaaggtgctcaatatcggctacgaaaacgacccggtgtttcgcgcgctggacggctcatccgtcaacctgtcgtccctgggcgtgcacgacacaccgcatgcgtcgaccaccgataacatcgtcagcttcaacgaccactacgcctcgacgctgtggaacgtgttgccgttttccatcgtcaacctgccgacctgggtctcgcatttgcccaccgcgtatggcgatggcatgacgcgcatcctggagtccgggttctatgagcagatgagccgcgattcgacgattatcgtcgccaacctgtccgacccggcgcgcgccaatacctgggtacaggatctgaaccgtaatgccgagccgcacaagggcgatactttcatcatcggcagtgacggcaatgacctgatccagggcggcaagggcgcggattttatcgagggcggcaagggcaatgacacgatccgcgataacagcgggcataacacttttctgttcagcggccagtttggccaggatcggctgattggctatcagcccacggacaagttggtgttccaggatgtgcagggaagtgtggattaccgtgagcaaggcggggatacggtgatcagctttggaggggactcggtgacgctggtgggagtgagtggctggtcgggggaggggattgtcattagctga

SEQ ID NO: 122 - protein, 470 aa, Unknown
  Obtained from an environmental sample.
MGVFDYKNVGAEGSKAVFADAMAITLYTYHNLDNGFAVGYQHNGLGLGLPATLVGALLGSTDSQGVIPGIPWNPDSEKAALDAVQKAGWTPISAGTLGYGGKVDARGTFFGEKAGYTTAQVEVLGRYDDAGKLLEIGIGFRGTSGPRESLISDSIGDLVSDVLAALGPRDYAKNYAGEAFGGLLKSVAEYAGAQGLSGKDVLVSGHSLGGLAVNSLADLSDAKWGGFYKDANYVAYASPTQSAGDKVLNIGYENDPVFRALDGSSVNLSSLGVHDTPHASTTDNIVSFNDHYASTLWNVLPFSIVNLPTWVSHLPTAYGDGMTRILESGFYEQMSRDSTIIVANLSDPARANTWVQDLNRNAEPHKGDTFIIGSDGNDLIQGGKGADFIEGGKGNDTIRDNSGHNTFLFSGQFGQDRLIGYQPTDKLVFQDVQGSVDYREQGGDTVISFGGDSVTLVGVSGWSGEGIVIS

SEQ ID NO: 123 - DNA, 1413 bp, Unknown
  Obtained from an environmental sample.
atgggtatctttgattataaaaacctcgggaccgagggctcaaaagcattgttcgccgatgccatggcgatcacgttgtattcctatcacaacctggataacggctttgccgtggggtaccagcacaacggcctggggctgggcttgccagctacgttggtcggggcgctgttgggcagcacggactcccagggcgtaatccccggcatcccctggaacccggactccgaaaaagccgcgctggacgcggtacacaaggccggttggacgcccatcagcgccagcaccctgggttacagtggcaacgtcgatgcgcgaggcaccttctttggcgagaagacgggctacaccacggcccaggtcgaagtgctgggcaagtacgatgacgccggaaaactgctggaaatcggcattggttttcgcggcacttcggggcctcgggaaaccttgatcagcgattccatcggtgacctggtcagcgacctgctggccgccctgggccccaaggattacgcgaagaattacgccggggaagccttcggcgggttgctcaagaatgtggccgactacgccagcgcccatggcttgagcggtcacgatgtggtggtcagcggccacagcctgggcgggctggcagtcaacagcatggccgacctgagcaacagcaagtggtcggggttctacaaggacgcgaactacgtggcctacgcctcgccgacccagagtgccagcgacaaggtgctcaacatcggctacgagaatgacccggtgttccgtgcgctggatggctcatccttcaccctgtcttccctgggtgtgcacgacaccccccatgagtccaccaccgacaatattgtcagtttcaacgaccactacgcctcgacgctgtggaatgtgctgccgttttccattgtcaatctgccgacttgggtttcgcacctgcctaccgggtacggcgatggcctgagtcgcgtgctcgactccgggttctatgagcaaatgacccgcgactccgccgtgatcgtcgccaacctgtccgacccggcacgggccaccacctgggtgcaggacctcaaccgcaatgccgagccgcataagggcaataccttcatcatcggcagcgacggccacgacctgatccagggcggcaagggtgcggactttatcgaaggcggcaaaggcaatgacacgattcgtgacaacagcgggcacaacacctttttgttcagcggtcagtttggccaggaccggatcatcggctatcagccaagcgatcaactggtattcaaggaggtagaggggagtgctcaataccgtgagcacggaggggacacagtgatcagcttcggcgcagattcggtgacattggtgggggtcaacgggtggtcgggggagggcgttgccatcggttga

SEQ ID NO: 124 - protein, 470 aa, Unknown
  Obtained from an environmental sample.
MGIFDYKNLGTEGSKALFADAMAITLYSYHNLDNGFAVGYQHNGLGLGLPATLVGALLGSTDSQGVIPGIPWNPDSEKAALDAVHKAGWTPISASTLGYSGNVDARGTFFGEKTGYTTAQVEVLGKYDDAGKLLEIGIGFRGTSGPRETLISDSIGDLVSDLLAALGPKDYAKNYAGEAFGGLLKNVADYASAHGLSGHDVVVSGHSLGGLAVNSMADLSNSKWSGFYKDANYVAYASPTQSASDKVLNIGYENDPVFRALDGSSFTLSSLGVHDTPHESTTDNIVSFNDHYASTLWNVLPFSIVNLPTWVSHLPTGYGDGLSRVLDSGFYEQMTRDSAVIVANLSDPARATTWVQDLNRNAEPHKGNTFIIGSDGHDLIQGGKGADFIEGGKGNDTIRDNSGHNTFLFSGQFGQDRIIGYQPSDQLVFKEVEGSAQYREHGGDTVISFGADSVTLVGVNGWSGEGVAIG

SEQ ID NO: 125 - DNA, 1350 bp, Unknown
  Obtained from an environmental sample.
atggcaacaatgatgcgcggagcaagcaagctcctggctggcatggccctggcggtatcggctttgactgcaaccggcgaagcgttcgccgcgaacaatctgccgattgtattggtacacggctttatcggcttcggcccgaacgagctgcaaggcaccggtttcaaatactggggcggtttcaacgatgtcgaggcttacctcagaaccaataacggcagccatcaggttcataccgccgcagtgggcccggtcagctcgaactgggatcgtgcggtcgagctgttctatcagatcaagggcggctgtgccgattacggcgctgcacgcaccgccagatttgctgcctacggcaaaatccagaagccggccggcaaatgctgggcgaccgacccgaacaacaacccgaacaactacccgttggcactgtacccgcaatgggatgccgcccacccgatccatctggtgtcgcacagccagggcggtcagaccatccgcacgatgatccagctgctggaaaacggctcgccttacggcaatgaaggcaacggcgcactgtataccggcggcaagatcggctgggtgaaaagcgccaccaccatttccaccccgcataacggcaccacgctgcgcgacgtgatcatcgactacgtaccgaaaatttccgaactggccggcaaagtcgtcgaagtggccggactcggcggcagcggcggccggatctacaacttcaagctggagcaatacggcctggcacaaggcccgtcggaaaacttccaggatttcatcaaccgcaccaagggcgcaccgtactggaaactggacaacaaagactcggcacagtgggatctgggcccggatggcgcgaaagagctgaacagctgggtcaagacctcgccgaacgtgtattactactcgatcgccaaccatgcaaccgaacagggcagcttctgctgcaacgaaaccgaccgcctgatcgccccgatccagagcagcaattaccagtatgcccgcaacgacatgatcttcttcctgaagaacaccgccggcgaatgggtggtcccgtccatcctcaaccgcggcatgggttcatacacccagaccgatccgagccgggtactgatcgacagcaactggttcctcaacgacggcgtggtcaactacatcagcatgaagtcgccgtcgggccagccggtacgcaactacaacggcacctcggtcaagggttactggaatcacctcggctactacaacaactacgatcacttcgacgtcatcggctggctgaactccagctcgaccgtttacccgatctacaactacctgaccggtatcctgtacggtctgtga

SEQ ID NO: 126 - protein, 449 aa, Unknown
  Obtained from an environmental sample.
MATMMRGASKLLAGMALAVSALTATGEAFAANNLPIVLVHGFIGFGPNELQGTGFKYWGGFNDVEAYLRTNNGSHQVHTAAVGPVSSNWDRAVELFYQIKGGCADYGAARTARFAAYGKIQKPAGKCWATDPNNNPNNYPLALYPQWDAAHPIHLVSHSQGGQTIRTMIQLLENGSPYGNEGNGALYTGGKIGWVKSATTISTPHNGTTLRDVIIDYVPKISELAGKVVEVAGLGGSGGRIYNFKLEQYGLAQGPSENFQDFINRTKGAPYWKLDNKDSAQWDLGPDGAKELNSWVKTSPNVYYYSIANHATEQGSFCCNETDRLIAPIQSSNYQYARNDMIFFLKNTAGEWVVPSILNRGMGSYTQTDPSRVLIDSNWFLNDGVVNYISMKSPSGQPVRNYNGTSVKGYWNHLGYYNNYDHFDVIGWLNSSSTVYPIYNYLTGILYGL

SEQ ID NO: 127 - DNA, 855 bp, Unknown
  Obtained from an environmental sample.
gtggctctcgtcgtcgatgacgaggattttgccttcaggttcgatcacggccatcatgggatccgacgggccgggcggccggtccccctcaggctcagggccgcatccctgattctcaccctggtcctgacggcagctctgctggcaggtatcacaacggctcccccagcagaggcaacgaccggacgaaatcccgttctcctggtgcacgggctaacggccgactcgctctcctggctggtcttcaaggcgagactggagagggacggcttccgggtcttcacggtcgacataccggacaggggattcggcgacatagccaggaactcccagtacgtggccgccaaggtcgacgaaataaggagggtgaccggagccgccaaggtcgacgtgatcggacactccgaagggggactgctcgcccgccactacatcaagtacaggggtggggcggaccaggtcggcagatatatcagcctcgggaccccacagtacgggaccgtcctcgccaacttctccacggtcttcaacttggcgagtctggtgggttgtgtcgcctgctaccagatgaccacagggtcgtccttcctggccaacctcaactcgggagacgacaccccgggtccggtgaagtacacgacgatctacacggtctatgacgagctggtccagccctactggaacgccgccttggggaaccagccggtgaccaacgtcaagatccagagcatctgcccgaaccgcgtggtggggcacatcggactggtcctggacggcacgacataccagatcgcccgagcggcgctcagggatcagacgccctcctggagcaacgtcaactgctgggcgctctga

SEQ ID NO: 128 - protein, 284 aa, Unknown
  Obtained from an environmental sample.
VALVVDDEDFAFRFDHGHHGIRRAGRPVPLRLRAASLILTLVLTAALLAGITTAPPAEATTGRNPVLLVHGLTADSLSWLVFKARLERDGFRVFTVDIPDRGFGDIARNSQYVAAKVDEIRRVTGAAKVDVIGHSEGGLLARHYIKYRGGADQVGRYISLGTPQYGTVLANFSTVFNLASLVGCVACYQMTTGSSFLANLNSGDDTPGPVKYTTIYTVYDELVQPYWNAALGNQPVTNVKIQSICPNRVVGHIGLVLDGTTYQIARAALRDQTPSWSNVNCWAL

SEQ ID NO: 129 - DNA, 1305 bp, Unknown
  Obtained from an environmental sample.
atgagaactcgcattaatcgcttcggtcttggcgcagcgctgatttgcgccggtttaggtatggcttccattgcccaggcagccaataattatccggtgatttttgtgcatggctttgccggctttggtcctaccgaaatgctgggatataaatactggggcggcttgaccgatctccagtcgcaactgcaagccaaatacaccaatcaactcgtaagaacagccacggtcggcccattcagttccaactgggatcgcgcggtggaactgttctatcagatcaagggcggctgcgtagattatggcgagatgcacgcacagacttatggccatctgcgccagccggaagcttattatcacaacgggcgcacctgttatccgggcctctatcccgcctgggacgccagccatccggtgcatctggtttcgcacagcatgggcggccaaacctcgcggatgctggtgcaactgctgaaggataacggcacaccgaccaatcccggtttattcccttcctcctacaccaccagttcagactggataaagagcgtcaccacgatctccacccccaacgatggcaccacgctggcctaccgggtcaccgactgggtccccttcgtgcagcagctcgtcaccggcattgccggcatagcgggagtgaccggcaatccggccaccaaaatttatgatttcaagatggatcagtggaagatcggcccgcaaacgagtagtgaaggcttcactaactatgtgagccgggtgatgaactcacctctgtggtccaatagccagttaaaagatatttccacctacgacttgagtccagccggggcgatggaagaaaaccactgggtcaaggatcagccgaatgtttactacttctcggtaagcaccaaatcctccaccaccggtctcattacgggctgggaatatccgatagcgtccgctaatcccctgctcgggatattggccgggccgggctggatgggtaatttcacgcctgatagtcgcccattcccgtattcagcgagcaatccggtgtataatatctggtgggcgactgacacggtggtgccgacgatttcaatgaaagcgcccacttgggcaatgaatgagcacggtgagatttatccacgccaggttatcataaaggacctcagtaatggtggcgctccgcaggttggcgcctggaactggaaagggctgatggatacctgggatcacatggacatcattggctggacgctgttctgggacagcgtgggctggtataagaaacacgttgatcaactgcgttcgctttga

SEQ ID NO: 130 - protein, 434 aa, Unknown
  Obtained from an environmental sample.
MRTRINRFGLGAALICAGLGMASIAQAANNYPVIFVHGFAGFGPTEMLGYKYWGGLTDLQSQLQAKYTNQLVRTATVGPFSSNWDRAVELFYQIKGGCVDYGEMHAQTYGHLRQPEAYYHNGRTCYPGLYPAWDASHPVHLVSHSMGGQTSRMLVQLLKDNGTPTNPGLFPSSYTTSSDWIKSVTTISTPNDGTTLAYRVTDWVPFVQQLVTGIAGIAGVTGNPATKIYDFKMDQWKIGPQTSSEGFTNYVSRVMNSPLWSNSQLKDISTYDLSPAGAMEENHWVKDQPNVYYFSVSTKSSTTGLITGWEYPIASANPLLGILAGPGWMGNFTPDSRPFPYSASNPVYNIWWATDTVVPTISMKAPTWAMNEHGEIYPRQVIIKDLSNGGAPQVGAWNWKGLMDTWDHMDIIGWTLFWDSVGWYKKHVDQLRSL

SEQ ID NO: 131 - DNA, 1854 bp, Unknown
  Obtained from an environmental sample.
atgggtgtgtatgactacaagaacttcagcacagcggattccaaggcgttattcagcgatgccatggccattacgctgtactcctatcacaacctcgacaacggttttgcggtcggctatcagcacaacggcttcggcctcgggctgccggccacgctgatcagcgcgctgatcggcggcaccgattctcaaggggtgattcccggacttccctggaaccccgactcggaaaaactcgccctcgatgccgtgaaaaaggctggctggacgcccatcactgcgtcgcaactgggctatgacggcaagactgatgttcgcggaaccttcttcggcgaaaagcccggttacaccagtgcgcaagtggaaatcctcggcaagtacgacgctcagggtcatctcacggaaataggcatcgcctttcgcggcaccagcggcccacgggaaatcctgattggtgactccatcgccgacgccatcaatgacctgctcgctgcattcggccccaaggattacgccaagaactacgtcggcgaagccttcggcaacctgatgaacaacgtggtggcgttcgccaaggccaacggcctcagcggcaaggacgtactggtcagtggccacagcctcggtgggctggcggtcaacagcatggcggacctgagtggcagcaaatggggcgggttcttccagaactccaactacatcgcctacgcctcgccgacccagagcagcaccgacaaagtgctcaacgtcggctacgagaacgatccggtattccgcgccctcgacggctcgaccttcaccggtgcatcgcttggcgttcacgacgcgtcgaaagtctcggccaccgacaatatcgtcagcttcaacgaccactacgcctcgaacgcgtggaacgtgctgccgtattcgatcgtcaacatcccgacctggatctcgcacctgccgacggcttacggcgacggcatgaaccgggtcatcgagtcgaagttctacgacctcaccagccgtgattcgacgattatcgtggccaacctgtcggacccggcgcgggccaacacctgggtgcaggacctcaaccgcaacgccgagccccacaagggcagcaccttcatcatcggcagcgacggtaacgatctgatccagggcggcagcggcaacgattatctggaaggccgtgccggcaatgacaccttccgtgacagcggcggctacaacatcattctcggcggttcaggcaacaacacccttgagctgcagcagtcggtgaacaagttcgacttcgccaacgacggcgccggcaacctgtacatccgcgatgccaacggcgggatcagcatcacccgcgacatcggcagcatcgttaccaaggagccgggcttcctctggggcctgttcaaggacgacgtgacccacagcgtgaccgccgatggcctgaaggtcggcaacaacgtcacccagtacgagtcgagcgtgaagggcaccagtggcgccgacaccctcaaggcccacgccagcggtgactggctattcggcctggacggcaacgatcacctgatcggcggcgcgggtaacgacgtgttcgtcggcggcgccggcaatgacctgatggagtcgggcggcggggcggatacgtttctgttcagcggcgcattcggccaggaccgggtggtgggcttcaacggcaacgacaaactggtgttcctcggggtgcagggcgtgttgcccggcgatgacttccgcgcccatgccacgtcggtggggcaggatacggtgctgaagtttggcgctgattcggtgacgctggtcggggtttcgctgagcagtctcagcgccgatgggatcgtgatcgcctga

SEQ ID NO: 132 - protein, 617 aa, Unknown
  Obtained from an environmental sample.
MGVYDYKNFSTADSKALFSDAMAITLYSYHNLDNGFAVGYQHNGFGLGLPATLISALIGGTDSQGVIPGLPWNPDSEKLALDAVKKAGWTPITASQLGYDGKTDVRGTFFGEKPGYTSAQVEILGKYDAQGHLTEIGIAFRGTSGPREILIGDSIADAINDLLAAFGPKDYAKNYVGEAFGNLMNNVVAFAKANGLSGKDVLVSGHSLGGLAVNSMADLSGSKWGGFFQNSNYIAYASPTQSSTDKVLNVGYENDPVFRALDGSTFTGASLGVHDASKVSATDNIVSFNDHYASNAWNVLPYSIVNIPTWISHLPTAYGDGMNRVIESKFYDLTSRDSTIIVANLSDPARANTWVQDLNRNAEPHKGSTFIIGSDGNDLIQGGSGNDYLEGRAGNDTFRDSGGYNIILGGSGNNTLELQQSVNKFDFANDGAGNLYIRDANGGISITRDIGSIVTKEPGFLWGLFKDDVTHSVTADGLKVGNNVTQYESSVKGTSGADTLKAHASGDWLFGLDGNDHLIGGAGNDVFVGGAGNDLMESGGGADTFLFSGAFGQDRVVGFNGNDKLVFLGVQGVLPGDDFRAHATSVGQDTVLKFGADSVTLVGVSLSSLSADGIVIA

SEQ ID NO: 133 - DNA, 1689 bp, Unknown
  Obtained from an environmental sample.
atgggattgttcgattacaaaaatgccgacggcaaagcgctgtacagcgacgccatcgccctgacgctgtatgcctacacgccgaccgggcaggccttgcccggcactggctggaagccgatcggcgccacggcgctgggctatcagggcaaggtcggggcgcagggcacgttcttcggcgagaaggacggctttaccagcgccgaagccgaagtgctcggcaagtacgacgccgcgggcaagctgatcggcatcggcgtggccttccggggcaccggcgggctgggttacagcgacaccttcggcgacatgaaaaacaatctgctggccgccatcggcccgacggattacgccacccagtacgcgaaaaatgctttcgacaacctgctcaaatcggtggcggctttcgccatcgcccacggcatcgcggccaaggacgtaatgatcagcggccacagcctcggcggcctcggggtcaacagcgtggcggagttgagcgcgagcaactggggcgggttcttcaaggacgccaactacatttcgttcgcctcgccgacccagagcagcaccggcaccaacgtgctgaacatcggctacgagaacgacccggtgttccgcgtgctcgacggcaccacgttcagtaccgcgtcgatgggcaagcacgacaagccgcacgactcgaccaccgacaacatcgtcaacttcaacgacaactacgcgtccaccgcgcagaacctggtgccattcagcatcgccaatccgctgaactggtcggcccacagctcgctggggtatgccgacggactgaaccgggtgatcgcgtcgaagttctacggcctgacgcacaaggattcgacgatcatcgtctccaaccttgaagaagcgtcgcggggcaagacctgggtcgaggatctgggccgcagcggcgagccgcacaccggcagcacgttcatcatcggcaccgacagcggtgactggctcaagggcggggcgggcaacgacttcctcgaagggctgggcggcgatgaccgtttccgtgacgacggcggcttcaacatcctgctcggtggccagggccacaacaccttcgagctgcaaaagccgttgcagaacttcagcttcgccaacgatggcgacggcacgctgtacgtgcgtgacgcctacggcggcatcagcatgacccgtgacatcggcgcgctggtgagcaaggagtcggggtcgtggtggggcagcaaggaaatcacctggaccgtcaccgccaaaggcctggccaacggtgccgaactgacgcagtacaaccattcgctcagcggcggcgccatgggcgacaccctcaaagccaccgctgacggcgactggctgttcggcctgggcggcaacgatcacctgcaaagcgacaaggcccacgtgaccttcgtcggcggtgccggcaacgacgtgatgagcgcggtgggtggcaataacaccttcctgttcagcggcgccttcggcttcgacgcgatcaatggctaccagggcagcgacaaactggtgttcacgggcgtcgaaggcgcggggcagggctacgactacaagcaacacgcgtcgcagtccggaagcgataccgtgctgaagattggcgactttgccgtgacgctggtcggggtaggtgtggctaacctgtcggattcgagtttcgtcttcgcctga

SEQ ID NO: 134 - protein, 562 aa, Unknown
  Obtained from an environmental sample.
MGLFDYKNADGKALYSDAIALTLYAYTPTGQALPGTGWKPIGATALGYQGKVGAQGTFFGEKDGFTSAEAEVLGKYDAAGKLIGIGVAFRGTGGLGYSDTFGDMKNNLLAAIGPTDYATQYAKNAFDNLLKSVAAFAIAHGIAAKDVMISGHSLGGLGVNSVAELSASNWGGFFKDANYISFASPTQSSTGTNVLNIGYENDPVFRVLDGTTFSTASMGKHDKPHDSTTDNIVNFNDNYASTAQNLVPFSIANPLNWSAHSSLGYADGLNRVIASKFYGLTHKDSTIIVSNLEEASRGKTWVEDLGRSGEPHTGSTFIIGTDSGDWLKGGAGNDFLEGLGGDDRFRDDGGFNILLGGQGHNTFELQKPLQNFSFANDGDGTLYVRDAYGGISMTRDIGALVSKESGSWWGSKEITWTVTAKGLANGAELTQYNHSLSGGAMGDTLKATADGDWLFGLGGNDHLQSDKAHVTFVGGAGNDVMSAVGGNNTFLFSGAFGFDAINGYQGSDKLVFTGVEGAGQGYDYKQHASQSGSDTVLKIGDFAVTLVGVGVANLSDSSFVFA

SEQ ID NO: 135 - DNA, 942 bp, Unknown
  Obtained from an environmental sample.
atgaccggatttttcagccgcctattgcggcgacttgcgctggcggccactgcagggcttttgctgctgggggccagcgtccatgcgcaaaacggctacacacaaacgcgctaccccatcgtgctggtgcatgggctttttggttttgactcggcgctgggcattgactacttctacggcatccccgatgccttgcgccagggcggcgccaaggtctacgtggcgcaggtgtcggcggccaacagcaccgaggtgcgcggcgagcagttgctggcacaggtcaaaaccatcctggcgatgaccggtgccgccaaggtcaacctggtcggccattcgcacggcgggcccaccacgcggtatgtggcgggcgtggcgccgcaactggtggcgtcggtcacgtcgattggcggggtgaacaagggctcgcgcgtggcagacatcctgcggggcgtggcgccttccggatcggtgtctgaaaccgtggccaatgcagcggccaaggcgctggtgggcctgattaatctgacgtcgggcggtaccggcctgccccagatgcccacggcggcgctggactcgctcaccacggcgggctctgccaagttcaacagccgctttccgcaaggcgttcctacctcgggctgcggcaatggggcagagctggtcaacggcgtgcgttattactcgtggaccggcacgcagccgctgaccaatgtgctcgacgccagcgacggcctgctcagtgtgatgagtctgacctttggcgaagccaatgacggcctggtgtcggcctgttcgtcgcgcctgggcaaacacctgggcgactaccgccagaaccacctggacgaggtcaaccagctgctgggcctgcgcgactggttctctaccgacccggtaacgctgtaccgccagcacgccaaccgcctgaagacgctgggcctgtaa

SEQ ID NO: 136 - protein, 313 aa, Unknown
  Obtained from an environmental sample.
MTGFFSRLLRRLALAATAGLLLLGASVHAQNGYTQTRYPIVLVHGLFGFDSALGIDYFYGIPDALRQGGAKVYVAQVSAANSTEVRGEQLLAQVKTILAMTGAAKVNLVGHSHGGPTTRYVAGVAPQLVASVTSIGGVNKGSRVADILRGVAPSGSVSETVANAAAKALVGLINLTSGGTGLPQMPTAALDSLTTAGSAKFNSRFPQGVPTSGCGNGAELVNGVRYYSWTGTQPLTNVLDASDGLLSVMSLTFGEANDGLVSACSSRLGKHLGDYRQNHLDEVNQLLGLRDWFSTDPVTLYRQHANRLKTLGL

SEQ ID NO: 137 - DNA, 1854 bp, Unknown
  Obtained from an environmental sample.
atgggtgtgtatgactacaagaacttcagcacagcggattccaaggccttgttcagcgacgccatggccatcacgctgtactcctatcacaacctcgacaacggtttcgcggtcggctatcagcacaacggtttcggcctcggcctgccggccacgctgatcagcgcactgatcggcggtaccgattctcaaggggtgattcccggactcccgtggaatcccgattcggaaaaactcgccctcgacgccgtgaagaaagccggctggacaccgatcaccgcctcgcaactgggctatgacggcaagactgacgtgcgcggaaccttcttcggcgaaaagcccggctacaccagcgcccaggtggaaatcctcggcaagtacgacgcccagggccatctcacggaaatcggcatcgcctttcgcggcaccagtggcccacgggaaatcctgattggtgactccatcgccgacgccatcaatgacctgctcgctgcattcggccccaaggattacgccaagaactacgtcggtgaagccttcggcaacctgatgaacaacgtggtggcgttcgccaaggccaacggcctcaccggcaaggacgtactggtcagcggccacagcctcggcgggctggcggtcaacagcatggcggacctgagcggcagcaagtggggcgggttcttccaggactccaactacatcgcctatgcctcgccgacccagagcagcaccgacaaggtactcaacgtcggctacgagaacgacccggtgttccgcgccctcgacggctcgaccttcaccggcgcctcgcttggcgtacacgacgcgtcgaaagtgtcggccaccgacaatatcgtcagcttcaacgaccactacgcctcgaacgcgtggaatgtgctgccatattcgatcgtcaacatcccgacctggatctcgcatctgccgacggcttacggcgacggcatgaaccgggtcatcgagtcgaagttctacgatctcaccagccgtgactcgacgatcatcgtggccaacctgtcggacccggcgcgggccaacacctgggtgcaggatctcaaccgcaacgccgagccccacaagggcagcaccttcatcatcggcagcgacggcaacgacctgatccagggcggcagcggtaacgattatctggaaggccgtgccggcaacgacaccttccgcgacagcggcggctacaacatcatcctcggcggttcaggcaacaacaccctcgagttgcagcagtcggtgaacaagttcgacttcgccaacgacggcgccggcaacctgtacatccgcgatgccaacggcgggatcagcatcacccgcgacatcggcagcatcgttaccaaggaaccgggcttcctctggggcctgttcaaggacgacgtgacccacagcgtgaccgccgatggcctgaaggtcggcaacaacgtcactcagtatgagtcgagcgtgaagggcaccagtggcgccgacaccctcaaggcccatgccggtggcgactggctgttcggcctggacggcaacgatcacctgatcggtggcgcgggcaatgacgtgttcgtcggcggcgccggcaatgacctgatggagtccggtggcggggcggataccttcctgttcagcggcgcgttcggccaggaccgggtggtgggcttcaacggcaatgacaaactggtgttcctcggcgtgcagggcgtgttgcccggcgatgacttccgcgcccatgccacgtcggtggggcagtatacggtactgaagttcggtgccgattcggtgacgctggtcggggtatcgctgaacagtctcagcgccgatggcatcgtgatcgcctga

SEQ ID NO: 138 - protein, 617 aa, Unknown
  Obtained from an environmental sample.
MGVYDYKNFSTADSKALFSDAMAITLYSYHNLDNGFAVGYQHNGFGLGLPATLISALIGGTDSQGVIPGLPWNPDSEKLALDAVKKAGWTPITASQLGYDGKTDVRGTFFGEKPGYTSAQVEILGKYDAQGHLTEIGIAFRGTSGPREILIGDSIADAINDLLAAFGPKDYAKNYVGEAFGNLMNNVVAFAKANGLTGKDVLVSGHSLGGLAVNSMADLSGSKWGGFFQDSNYIAYASPTQSSTDKVLNVGYENDPVFRALDGSTFTGASLGVHDASKVSATDNIVSFNDHYASNAWNVLPYSIVNIPTWISHLPTAYGDGMNRVIESKFYDLTSRDSTIIVANLSDPARANTWVQDLNRNAEPHKGSTFIIGSDGNDLIQGGSGNDYLEGRAGNDTFRDSGGYNIILGGSGNNTLELQQSVNKFDFANDGAGNLYIRDANGGISITRDIGSIVTKEPGFLWGLFKDDVTHSVTADGLKVGNNVTQYESSVKGTSGADTLKAHAGGDWLFGLDGNDHLIGGAGNDVFVGGAGNDLMESGGGADTFLFSGAFGQDRVVGFNGNDKLVFLGVQGVLPGDDFRAHATSVGQYTVLKFGADSVTLVGVSLNSLSADGIVIA

SEQ ID NO: 139 - DNA, 1689 bp, Unknown
  Obtained from an environmental sample.
atgggattgttcgattacaaaaatgccgacggcaaagcgctgtacagcgatgccatcgcgctgacgctgtattcctacacgccgaccgggcagcctttgcccggcaccggttggtcgccactgggcgcctcggccctgggttatcaaggcaagaccgacgcgaaagggacgttcttcggcgagaaggacggcttcaccagcgccgaggcggaagtgctcggcaaatacgacgccgccggcaagctgatcggcatcggcgtggcctttcgcggcactggcgggctgagttacagcgacaccttcggcgacatgaaaaacaacctgctggccgccatcggtccggtggattacgccaagaattacgcgaagaacgccttcgacaacctgctcaaatccgtcgccgcgtttgccacggctcacggcattgccgccaaggacgtgctgatcagcggccatagcctcggcgggctcggggtcaacagcgtggcggaactgagcgtgagcgactggggtggtttcttcaaggacgccaactacatttcgttcgcctcgccgacccagagcagcaccggcaccaacgtgctgaacatcggctacgagaacgatccggtgttccgtgtgctcgacggcaccacgttcagcacggcgtcgatgggcaaacacgacaagccgcacgactcgaccaccgacaacatcgtcaacttcaacgacaactacgcgtccaccgcgcagaacctggtgccgttcagcatcgtcaacccgctgaactggtcggcccacagctcgctggggtatgccgatggcctgaaccgggtgatcgactcgaagttctacaacctcaccagccaggattcgaccattatcgtgtccaatctggaagcctcgtcccggggcaagacctgggtcgaagatctgggccgcagcggcgagccgcacaccggcagcactttcatcatcggcaccgacagcaacgactggctcaagggcggggcgggcaacgacttcctcgaaggccgtgccggcgatgacctgttccgtgatgacgggggcttcaacattctgttgggcggccagggccacaacaccttcgacctgcagaaaccgttgcagaacttcagcttcgccaacgacggcgacggcacgctgtacgtgcgcgacgcctacggcggcatcagcatgacccgtgacatcggcgcaatcgtgagcaaagagtccggttcgatgtggagcagcaaggaaatcacctggaccgtcaccggcaaaggcctggccaacggcgccgaactgacccagtacaaccattcgctcaacggcggcgcactcggcgacacgctgaaagccaccgcggacggcgactggctgttcggcctgggcggcgacgatcacctgttcagcgacaaggcccacgtgaccttcgtcggcggcgccggcaatgacgtgatgaatgcggtgggtggcaacaataccttcctgttcagcggcgcgttcggcttcgactcgatccatggctaccagggcagcgacaaactggtgttcatgggcgtgcagggcgcggggcagggctacgactacaagcaacatgcttcgcagtccggcgccgataccgtgctgaagattggcgactatgccgtgaccctgatcggggtgggtgtggctaacctgtcggactcgagtttcgtgttcgcctga

SEQ ID NO: 140 - protein, 562 aa, Unknown
  Obtained from an environmental sample.
MGLFDYKNADGKALYSDAIALTLYSYTPTGQPLPGTGWSPLGASALGYQGKTDAKGTFFGEKDGFTSAEAEVLGKYDAAGKLIGIGVAFRGTGGLSYSDTFGDMKNNLLAAIGPVDYAKNYAKNAFDNLLKSVAAFATAHGIAAKDVLISGHSLGGLGVNSVAELSVSDWGGFFKDANYISFASPTQSSTGTNVLNIGYENDPVFRVLDGTTFSTASMGKHDKPHDSTTDNIVNFNDNYASTAQNLVPFSIVNPLNWSAHSSLGYADGLNRVIDSKFYNLTSQDSTIIVSNLEASSRGKTWVEDLGRSGEPHTGSTFIIGTDSNDWLKGGAGNDFLEGRAGDDLFRDDGGFNILLGGQGHNTFDLQKPLQNFSFANDGDGTLYVRDAYGGISMTRDIGAIVSKESGSMWSSKEITWTVTGKGLANGAELTQYNHSLNGGALGDTLKATADGDWLFGLGGDDHLFSDKAHVTFVGGAGNDVMNAVGGNNTFLFSGAFGFDSIHGYQGSDKLVFMGVQGAGQGYDYKQHASQSGADTVLKIGDYAVTLIGVGVANLSDSSFVFA

SEQ ID NO: 141 - DNA, 927 bp, Unknown
  Obtained from environmental sample
gtgagcattcgtctgcgactgttaaactggtttttgaatacctttgaaaaaccaaaactggccgcggccaaaacgccggatgatttgcgaaaatcgtttgaattaaaggcgaggtttttgtttccggcgccacgtaaaacaaggtttagtcatgatgtattgcagtcaggcatcgggtcggtaaatgcccagtgggcgaaatccaaatctgcatctgatgacagggtaatcctgtattttcatgggggagggtatgtttttgggtcaccaaaaacgcaccgtgcaatgttggcgcgcttgtcggcaatgacaggtctttctgcgtgccttccagattataggttggcaccagagcacccatttccagccgcgatcgaagatgcagttttatcgtataaatgtttactagagcgagcaatcgagccccaaaatattatactggggggggacagtgctggtggcggtttggttcttgctttgcttgcagaaatcaaggcccaatccttgcccaaacctgctggcgtttttgccttgtcgcctttggttgatttatcattttcgggcctttcgttttctaaaaatgcccaaaccgatgtgatgttgcccgcatcacgggctgcggatatggcgaccttgtatttggatggggccgatgcagatgatccacgtgcatcgccgctgcaggcggatttttctggcatgccgcctgtatttctgacagcaagtgacagtgaaatcctgttggatgattgcctgcggatggcggatcacttgcgtgcgcaaggtgtcgttgtgacagaccggattgttgaaaaccatccacatgtttggcatatttttcaacgccttctacccgaagcagatcaggggctgcgggcgattgccgcgtggattaaacctcttttatcaggttcaaacgaaagctaa

SEQ ID NO: 142 - protein, 308 aa, Unknown
  Obtained from environmental sample
MSIRLRLLNWFLNTFEKPKLAAAKTPDDLRKSFELKARFLFPAPRKTRFSHDVLQSGIGSVNAQWAKSKSASDDRVILYFHGGGYVFGSPKTHRAMLARLSAMTGLSACLPDYRLAPEHPFPAAIEDAVLSYKCLLERAIEPQNIILGGDSAGGGLVLALLAEIKAQSLPKPAGVFALSPLVDLSFSGLSFSKNAQTDVMLPASRAADMATLYLDGADADDPRASPLQADFSGMPPVFLTASDSEILLDDCLRMADHLRAQGVVVTDRIVENHPHVWHIFQRLLPEADQGLRAIAAWIKPLLSGSNES

SEQ ID NO: 143 - DNA, 843 bp, Unknown
  Obtained from environmental sample
gtgactcggggggagcacgtgcgcctgccagcggggctccccatcgacgtcgagcgggtgggaaccggccccccgctcgtcttcctgcacggcttcggagccagccggttcagttggaggcactgggtggaggcgctcagtggagactacacgctgtacctggtcgacctgcgcggattcggggccgcgccccccgcgccggacgggcgctacggccctccggagatggcccgggacgtcgccggcctcgtccgctcgctcgacctggagcgggtgacgctggtggggcactcgatggggggcggggtggcgctgctggcctcgctgctgctacgggacgcgggcgagggggcacgcctcacgcgactcgtgagcgtggccggaaccgcctacgaccagcgtctaccgcccgtcatcggcctgctccgtctacggaccgggcgcgcgatcctccggcacctacccgcccacctcgtggtggcgcccgtcctccgacgcatcgtgtacgacccggcgtccgtcaccgcggagcaggtggaaggctactcgcgaccgctccgctcacgccccgcgcgcgaagcgctgatcgcctgcgtgcgccatctggttccggagaacctcgaccggatcgtcgcgcgctacccgggcctcgacctccccgcgctcctcatctggggacgccaggaccccgtcgtgcccctggcgttgggagagcgcctcgcgcgcgagctcccgcacgcgaggctggccgtgctcgagcgttgcggccacctgccggccgaggaacacccccaggcctcgctcgggctcctcagggccttcctggacgggtcaagctcttga

SEQ ID NO: 144 - protein, 280 aa, Unknown
  Obtained from environmental sample
  DOMAIN (50)...(273): alpha/beta hydrolase fold
MTRGEHVRLPAGLPIDVERVGTGPPLVFLHGFGASRFSWRHWVEALSGDYTLYLVDLRGFGAAPPAPDGRYGPPEMARDVAGLVRSLDLERVTLVGHSMGGGVALLASLLLRDAGEGARLTRLVSVAGTAYDQRLPPVIGLLRLRTGRAILRHLPAHLVVAPVLRRIVYDPASVTAEQVEGYSRPLRSRPAREALIACVRHLVPENLDRIVARYPGLDLPALLIWGRQDPVVPLALGERLARELPHARLAVLERCGHLPAEEHPQASLGLLRAFLDGSSS

SEQ ID NO: 145 - DNA, 765 bp, Unknown
  Obtained from environmental sample
atgcccgaacttaaaccgttgtggcccaacaaccagcgaccgaccgtttctttgcaggaatggcgcgcacccaaacccaatggaactggagttttggtgtgtcccggcggcggttacggcgcgctggcgaccggtcacgaaggcgacgacatcgcgcgttatctcaacgagcgcggcttcgatgcgtgggttttgcgctacaccatcgccagtgcgcaaaccccggggccgctgctggaaaagccgctggctgatgcgcagcgcgcgttgcgacaaattcattatggcccgaacgcgccacaaaagttgggcatctggggtttttccgccggtggacatctggcggcgacggtttccacgcagtggcaaaaaccgatcgaagacgcgccgcctttgcgccccgatttttcaattttggcgtatcccgtcatcacgatggacgcgtggacgcacggtggttcgcgccataatttgttggggccaacgccgacgccggagcaaatcgagcgcttttccaacgaaagacaggtgaacgcgcaaacaccgcccacgtttttgtttcacaccgccgatgatggcgcggtgcccgtcgaaaacgcgctacgctacgcgctggcgctggaaaaacacaaagtcccgtgcgaattgcattcgtatcgcagcgggccgcacggtgtggggctggccgcaaaccatccggcgctcaaaagctggggcgagttactggaaaggtggctgtcgagtttcgtagagaacacaaagtag

SEQ ID NO: 146 - protein, 254 aa, Unknown
  Obtained from environmental sample
MPELKPLWPNNQRPTVSLQEWRAPKPNGTGVLVCPGGGYGALATGHEGDDIARYLNERGFDAWVLRYTIASAQTPGPLLEKPLADAQRALRQIHYGPNAPQKLGIWGFSAGGHLAATVSTQWQKPIEDAPPLRPDFSILAYPVITMDAWTHGGSRHNLLGPTPTPEQIERFSNERQVNAQTPPTFLFHTADDGAVPVENALRYALALEKHKVPCELHSYRSGPHGVGLAANHPALKSWGELLERWLSSFVENTK

SEQ ID NO: 147 - DNA, 1275 bp, Unknown
  Obtained from environmental sample
gtgaacgactacttaaacaaacttttgaaaaattcgggtgaaatattgggaacacaacacagtggcgaggtgactgttggaaaacatcgctcgttaaatgttctgtcggtgctcgcggcggttctcgcgctcggcgcggcaatctggattgtcgttcccgcgccgtcttattacgtgtggcttctcgcagtcgcggcgagtgaatggagtttcgcgctcgccgcgctcgctcttttcagcatcgtcgccgcactgttttttgggcgcgggaaaattaaaaccgtgacgatttttaccggcgcgactgcttttttaatttcgctctacccatttgccgacgctttgacgacggcgcgcgaacacaatgtttcgccatcattcggacaatatgcaaccggctttttcgctcgaaacgagaggattgacaaagaaacctttacgttcgcaaccattgacggaaaatcgctcgagcttgatgtttattcgccgcccgccggcgttcaaaaaaacggcgccggcgtcgttgtcgttcacggcggttcgtggaacgcgggcgggcgcggcgattttccccgttggaacggctggctcgccgaaaacggctatacggttttcgacatcgattatcggctcgcgccgcagccgaattatttaacggcgactggtgacgttaaatgcgcggtcggatggataaaaacaaacgcagaacgatttggcatcgcacccgacaaaacaatcttgctcgggcgttcggcgggcgggcatctggcgctgctcgcagcttattcggtaaacgaccggcggcttccttcaagctgcgcgaacgcgaaatccggtgtgagcagcaatgccgccgatgaaaccgtgcgcgcggtcgtatcgttttacgcacccgtcgatttgatttggagtttcgataacccggcaaacgagctggtcataaacggcaaaaaaacgctcgctcaatttctcggcggcaatccgcacgaatcaagtgagatgcgcgaacgctatctgctcgcatcgcccgacacgcacgtcaattcgaacactgcgccgacgctgctcattcacggcgggcaggatcagcttgtcaggacggaaaatatgcacaggcttgccgaaaaattggacgcggaaaaagttccgcacgaaaccgtctctctcggctacgcccagcacggcttcgattataatttcaacggctggggcgcgcaagttgcgcaatcggttctgctcgactttttgcgtaaaaataccgaatccggcaaataa

SEQ ID NO: 148 - protein, 424 aa, Unknown
  Obtained from environmental sample
MNDYLNKLLKNSGEILGTQHSGEVTVGKHRSLNVLSVLAAVLALGAAIWIVVPAPSYYVWLLAVAASEWSFALAALALFSIVAALFFGRGKIKTVTIFTGATAFLISLYPFADALTTAREHNVSPSFGQYATGFFARNERIDKETFTFATIDGKSLELDVYSPPAGVQKNGAGVVVVHGGSWNAGGRGDFPRWNGWLAENGYTVFDIDYRLAPQPNYLTATGDVKCAVGWIKTNAERFGIAPDKTILLGRSAGGHLALLAAYSVNDRRLPSSCANAKSGVSSNAADETVRAVVSFYAPVDLIWSFDNPANELVINGKKTLAQFLGGNPHESSEMRERYLLASPDTHVNSNTAPTLLIHGGQDQLVRTENMHRLAEKLDAEKVPHETVSLGYAQHGFDYNFNGWGAQVAQSVLLDFLRKNTESGK

SEQ ID NO: 149 - DNA, 582 bp, Unknown
  Obtained from environmental sample
atgagcctactcaagatttatgatgatacaatttctggtccatgggaaaccgcagggattgacgtacagtaccggattaaagatggcgtcctgacattccagcagaccgtctcgaaatccgactggctccacaacttcgaaacatgggtaaagccctacaagcgacaacccattccctggtatgctcatgcagggtttgtaaagctctggaaatccgtgcgggatgaagtggcaaagtactacaaagatattcaccggattgccggttacagccaaggttctgcgcttgctcagctcgccgcagaagactactacttcacaaccggaaacgctatcgacacagtaggttttggctgcccgagagtattctggatgcctaacgactatgttcggaaggcacaagaaaaaaccaagttagtgatggtagataatgaccttgttacctgtgtgccatttgctctttggggataccggcacgtggggcaaaagataatacttcctggtactggtttgttaccatcgacaaaggctcattatcctgatgtgtacagatcgagacttgtcgctgaaagtgtgcagtaa

SEQ ID NO: 150 - protein, 193 aa, Unknown
  Obtained from environmental sample
  DOMAIN (26)...(155): Lipase (class 3)
MSLLKIYDDTISGPWETAGIDVQYRIKDGVLTFQQTVSKSDWLHNFETWVKPYKRQPIPWYAHAGFVKLWKSVRDEVAKYYKDIHRIAGYSQGSALAQLAAEDYYFTTGNAIDTVGFGCPRVFWMPNDYVRKAQEKTKLVMVDNDLVTCVPFALWGYRHVGQKIILPGTGLLPSTKAHYPDVYRSRLVAESVQ

SEQ ID NO: 151 - DNA, 1257 bp, Unknown
  Obtained from environmental sample
atgaaaataaagccgctcacgttttcttttggattagcagtcactagctcggtgcaagccttcactcaatttggcggacaaggcgttatgccgatgggtcacgaatggttaacgcgcaccgctgctctcgaggtacttaatgcagagcatatcatcgaagcggatccgaatgacccaagatatacttggcaggacggacttgctaaaaaccttgaacttaataccgcccaatctgaaatcacgcgcttacaatctcatttaaataataacccgctctatgagccgagatacgacggtataaactcagccatcgttggtgaacgctgggtcgatattgcagggtttaacgtcacaacagccagcgcagacccgactggccctaattgctttagcgcagtttcacaagagcccgcagatattcagcaagaccactttatgcgccgctatgatgatattggaggtcaaggtggagttgatgctgcttatcgcgcacagcaacgatttgtgcaacactttgtggatgcggccatggccgaaaaaaaacgactaaaagtatgggacggtggtggccattctgcgttagcagaggtagatcataattactttttatttggtcgtgcggttcacctatttcaagactcatttagtccagaacacacggtacggctccctcaagataactacgaaaaagtttggcaggttaaggcatatctttgctcagagggggctgagcaacattcacacgataccaaagacgtgctcaactttgccagtggcgatgttatttggcaacctcaaacccgactagaagcaggctggcaatcttaccagatcagcagtatgaagcccgttgctattgtggcccttgaagccagtaaagatctttgggctgcgtttattcgcaccatggcgaccccaaaagcacagagacgtaacgtggcaacgcaagaagcccaacaacttgtacaaaactggttgtcttttgatgaggcccagatgctgacttggtatcaagatgagaataagcgtgaccatacttatgtgcttgcccccaatgaaacgggaaaaggaaaatctctggaagcctgtatgacagagctaaaggtaggcactagcagtcaagcagaacgggttgcgcaactggaagccgagcgtaatcaatgcctatacaacattgaggcggaacctggctttgcagacttaaacgatccacacctcgatattccatataactggcgctggaagtctctgacttag

SEQ ID NO: 152 - protein, 418 aa, Unknown
  Obtained from environmental sample
  SIGNAL (1)...(20)
MKIKPLTFSFGLAVTSSVQAFTQFGGQGVMPMGHEWLTRTAALEVLNAEHIIEADPNDPRYTWQDGLAKNLELNTAQSEITRLQSHLNNNPLYEPRYDGINSAIVGERWVDIAGFNVTTASADPTGPNCFSAVSQEPADIQQDHFMRRYDDIGGQGGVDAAYRAQQRFVQHFVDAAMAEKKRLKVWDGGGHSALAEVDHNYFLFGRAVHLFQDSFSPEHTVRLPQDNYEKVWQVKAYLCSEGAEQHSHDTKDVLNFASGDVIWQPQTRLEAGWQSYQISSMKPVAIVALEASKDLWAAFIRTMATPKAQRRNVATQEAQQLVQNWLSFDEAQMLTWYQDENKRDHTYVLAPNETGKGKSLEACMTELKVGTSSQAERVAQLEAERNQCLYNIEAEPGFADLNDPHLDIPYNWRWKSLT

SEQ ID NO: 153 - DNA, 753 bp, Unknown
  Obtained from environmental sample
atggggagagagatgccgtatagggttgttttgcctgcgaagtatgacgagaagaaggacgtccgatatccggtgctctatctgcttcacggcctgacaggcaacaatacgaactggatcgagagaacaaagcttacggagtacctgtccgataccgggctgattgtagtaacacctgaaggcgagaacgggtggtacacggacagtgcgaatgatgcgaatggaaaatatgagagctatatagtttcagaactgataccggaggtcgatcaaaagtttcgaacgatagcggagcgtaaggggcgggcgatcgcggggctttcgatgggaggatatggggcgataaagttcgggttgaaatacccggagatgtttgtgctggcgggaagtttcagtggggcgttaggagccaccggatggccggagacaggcccggggtcggcgggtttggcttcgatccgagccgttttcggaccccaggacagcgaaacacggaaggcaaacgatattttcagaatgatccgggagatggagcctgagaaggcagagggcctgccgtttctttacatcgattgcggcacagaggatattctttttcagaacaaccgggattttgttgatctgctggttcaaaagaagatccggcacgagtatcgccatctgccgggcgggcatacttggttatattgggataagcagataaagccatttcttggcattacggtgtcgttactacacggcccaacatcttag

SEQ ID NO: 154 - protein, 250 aa, Unknown
  Obtained from environmental sample
  DOMAIN (1)...(241): Putative esterase
MGREMPYRVVLPAKYDEKKDVRYPVLYLLHGLTGNNTNWIERTKLTEYLSDTGLIVVTPEGENGWYTDSANDANGKYESYIVSELIPEVDQKFRTIAERKGRAIAGLSMGGYGAIKFGLKYPEMFVLAGSFSGALGATGWPETGPGSAGLASIRAVFGPQDSETRKANDIFRMIREMEPEKAEGLPFLYIDCGTEDILFQNNRDFVDLLVQKKIRHEYRHLPGGHTWLYWDKQIKPFLGITVSLLHGPTS

SEQ ID NO: 155 - DNA, 1689 bp, Unknown
  Obtained from environmental sample
atgggactgttcgattacaaaaatgccgacggcaaagcgctgtacagcgatgccatcgccctgacgctgtatgcctacacgccgaccgggcaggccttgcccggcactggctggaagccgatcggcgccacggcgctgggctatcagggcaaggtcggggtgcagggcacgttcttcggcgagaaggacggcttcaccagcgccgaagccgaagtgctcggcaagtacgacgccgcgggtaagctgatcggcatcggcgtggccttccgcggcaccggcgggctgggttacagcgacaccttcggcgacatgaaaaacaacctgctggctgccattggcccgtcggactacgccactcagtacgcgaaaaacgccttcgacaacctgctcaaatcggtggccgcgttcgctgtcgcccacggcattgcggccaaggacgtacttgtcagcggccacagcctcggcggtctcggggtcaacagcgtggcggagttgagcgcgagcaactggggcgggtttttcaaggacgccaactacatttcgttcgcctcgccgacccagagcagcaccggcacgaacgtgctgaacatcggctacgaaaacgacccggtgttccgcgtgctcgacggcaccacgttcagtaccgcgtcgatgggcaagcacgacaaaccgcacgattcgaccactgacaacatcgtcaacttcaacgacaactacgcgtccaccgcgcagaatctggtgccgttcagcatcgccaacccgctgaactggtcggcccacagctcgctggggtatgccgacggcctgaatcgggtgatcgcgtcgaagttctacggcctgacgcacaaggactcgacgatcatcgtctccaaccttgaggacgcgtcgcggggcaagacctgggtcgaggatctgggccgcagcggcgagccgcacaccggcagcacgttcatcatcggcaccgacagcggcgactggctcaagggcggggcgggcaacgacttcctcgaaggcctgggcggcgatgaccgtttccgtgatgacggcggtttcaacatcctgctcggtggccagggccacaataccttcgagctgcaaaagccgttgcagaacttcagcttcgccaacgacggcgacggcacgctgtacgtgcgtgacgcctacggcggcatcagcatgacccgcgacatcggcgcgctagtgagcaaggagtcgggttcgtggtggggcagcaaggaaatcacctggaccgtcaccgccaaaggcctggccaacggtgccgaactgacccagtacaaccattcgctcagcggcggcgccatgggcgacaccctcaaagccaccgccgacggcgactggctgttcggcctgggcggtaacgatcacctgcaaagcgacaaggcccacgtgaccttcgtcggcggtgccggcaatgacgtgatgagcgcggtgggtggcaacaacaccttcctgttcagcggcgccttcggttttgacgcgatcaatggctaccagggcagcgacaaactggtgttcatgggcgtcgaaggcgcggggcagggctacgactacaagcaacacgcgtcgcagtccggaagcgataccgtgctgaagattggcgactttgccgtgacgctgatcggggtcggtgtggctaacctgtcggattcgagtttcgtcttcgcctga

SEQ ID NO: 156 - protein, 562 aa, Unknown
  Obtained from environmental sample
  DOMAIN (82)...(212): Lipase (class 3)
MGLFDYKNADGKALYSDAIALTLYAYTPTGQALPGTGWKPIGATALGYQGKVGVQGTFFGEKDGFTSAEAEVLGKYDAAGKLIGIGVAFRGTGGLGYSDTFGDMKNNLLAAIGPSDYATQYAKNAFDNLLKSVAAFAVAHGIAAKDVLVSGHSLGGLGVNSVAELSASNWGGFFKDANYISFASPTQSSTGTNVLNIGYENDPVFRVLDGTTFSTASMGKHDKPHDSTTDNIVNFNDNYASTAQNLVPFSIANPLNWSAHSSLGYADGLNRVIASKFYGLTHKDSTIIVSNLEDASRGKTWVEDLGRSGEPHTGSTFIIGTDSGDWLKGGAGNDFLEGLGGDDRFRDDGGFNILLGGQGHNTFELQKPLQNFSFANDGDGTLYVRDAYGGISMTRDIGALVSKESGSWWGSKEITWTVTAKGLANGAELTQYNHSLSGGAMGDTLKATADGDWLFGLGGNDHLQSDKAHVTFVGGAGNDVMSAVGGNNTFLFSGAFGFDAINGYQGSDKLVFMGVEGAGQGYDYKQHASQSGSDTVLKIGDFAVTLIGVGVANLSDSSFVFA

SEQ ID NO: 157 - DNA, 960 bp, Unknown
  Obtained from environmental sample
atgcgcggtttcgcgcgttcaatcacttttcgtttggtgttcgctgcgactgcgttcgtcgttgcgctggcaacgttggcccaggcgcaaaacgacaagatgacacccatcgccacaccggcgcagcccaatgcgatcgagatcggaaccggtccgctgcccgatgcgaagaaccccgagtcctggcatagccagtacggcagcaagtttgcccgtaacgtaaccatagcgacgctgacaccatttctgccggatgctgccagggcaagcggcgccgcagtcatcgtcgcgcccggcggcggtttccgcaccttgtcgatggaaaatgaaggctggaacgttgcgcgcgccctggctgaaaagggcgtcgctgcgttcgtcctgaagtatcgattgaatcagaccccggcggacatgccgggcttcgagcagtccatgcgagaaatgttttcgggaacagcgcgaccgccgcgccccgacccggcgaaggctattgccggtcttgctccgcaaatcgccgacgcccgcgcggcatttgcattaatccgcaagcgttcttccgaatggcacgtcgatcctaaccggatcggcatggttggtttttccgccggcgcgatgttgaccatggcgaccgcgctcgcgggcgaggatgcgaagccggccttcatcggcaacatctacggtccgctcgcgtcagtcaccgtgccggctgacgcgcccccattgttcatcgcgcttgctgccgacgatcctttcttcgcgaacggcggctatgggctcatcgatagctggaagacggcgaagcggcccgttgaattccatctttatgaacagggtgggcatggcttcgggatgtatccgaaggaaacgacgagcaccggctggttcgaagccttcgtgcggtggataggaatgcacggcatgctgaagccggcagcgtcaggaagcggcgcgaagtag

SEQ ID NO: 158 - protein, 319 aa, Unknown
  Obtained from environmental sample
  SIGNAL (1)...(29)
MRGFARSITFRLVFAATAFVVALATLAQAQNDKMTPIATPAQPNAIEIGTGPLPDAKNPESWHSQYGSKFARNVTIATLTPFLPDAARASGAAVIVAPGGGFRTLSMENEGWNVARALAEKGVAAFVLKYRLNQTPADMPGFEQSMREMFSGTARPPRPDPAKAIAGLAPQIADARAAFALIRKRSSEWHVDPNRIGMVGFSAGAMLTMATALAGEDAKPAFIGNIYGPLASVTVPADAPPLFIALAADDPFFANGGYGLIDSWKTAKRPVEFHLYEQGGHGFGMYPKETTSTGWFEAFVRWIGMHGMLKPAASGSGAK

SEQ ID NO: 159 - DNA, 1002 bp, Unknown
  Obtained from environmental sample
atggatgccaataaagacggtgagatttcggttgaagaactgcaggcggtccggagccagttgccaagcgatctgctggccatgttggacgtcgctttatcaacccagagcactaattccggcaaatctgaaatcgccaattctgcgccgatgaaagcagctgtccccgaacggaaggggcctacaccattccttgatccgatgttcaagttcactgtaaccaagaacattcagtatgctacggcaaaaaacggagacacagagatgccgctgcttctggatatttaccgcccaaccgccgctaccaatttgccgaaaaaattgccggccgtgattttcctcttcggaggaggttggataaaaggaagcaaagacgtcaaatacatcaaggatttgtgtgaatactacgcgactcgcggctatgtggccttttcgattcaataccgcatccaaagagacaatcccccggcactgcctggaccagccccgtctcctgagaccaatgaaagataccggctgatgaatgccgcgattcacgacaccgcagatgccgttcgctgggtcagggccaatgccaacaaatacgatattgacccggatcgaatcgccatcgggggagtttccgccggagccttcaattcgctctacacgggcttctgtggtgaggacatcgtcggtcccaatgccaaagtggctgcagtgatctcgcttatgggcgtgattgaaactaagcatatagacaagaacgaccccccggtgtttatcgcccatggcacctcggataatttagttccctacgccatggtcgggagcgcggtgaagcggttgaatgaagttaaagcaaaatatgctttctatccggtagaaggtgtagctcatcgcattcaaaccattcttgatacagagtttgatgggaagacagtcagagatcacagtgttgatttctgtttcacggccatgaagctgtctgaaattattagaaagatagataacaatgaatga

SEQ ID NO: 160 - protein, 333 aa, Unknown
  Obtained from environmental sample
  DOMAIN (93)...(312): Phospholipase/Carboxylesterase
MDANKDGEISVEELQAVRSQLPSDLLAMLDVALSTQSTNSGKSEIANSAPMKAAVPERKGPTPFLDPMFKFTVTKNIQYATAKNGDTEMPLLLDIYRPTAATNLPKKLPAVIFLFGGGWIKGSKDVKYIKDLCEYYATRGYVAFSIQYRIQRDNPPALPGPAPSPETNERYRLMNAAIHDTADAVRWVRANANKYDIDPDRIAIGGVSAGAFNSLYTGFCGEDIVGPNAKVAAVISLMGVIETKHIDKNDPPVFIAHGTSDNLVPYAMVGSAVKRLNEVKAKYAFYPVEGVAHRIQTILDTEFDGKTVRDHSVDFCFTAMKLSEIIRKIDNNE

SEQ ID NO: 161 - DNA, 1851 bp, Unknown
  Obtained from environmental sample
atgcccgttttcgattaccgacagctcgacagcactgcctcttcctcgctctataaagatgccatggccctggccacctatgcctaccatggcatcgacgatggcttcagcgccggctaccagaagcacggcttcggcctgggcctgccggccaccctggtcaaggcgctgatcggtggcaccgacagccagggtgtgatccccggcatcccctggaaccccgactccgaagcccgcgccctggcccaggtcaaggccgccggctggacgccgatcagcgcggcgcaactgggctaccagggcaagaccgacggccgtggcaccttccacggcgaagcgccgggctacacctcggcgcaggtggaaatcctcggccgctacgatgccgccggccaactcagcggcatcggcatcgcctttcgcggcaccagtgggccgcgcgagaacctgctgggcgacaccatcggcgatgccatcaacgacctgttggcggcgatcggtccggccggttatgcccgtgactacgccggtaacgcattcgggcaactgctcgccgatgtggcggccttcgccaaggccaacggcctgagcggcgccgatgtcaccgtcagtggccacagcctcggcggcctggcagtcaacagcctggccgacctcagtggctcgcgctggggcggcttctaccaggatgcgcgctacgtcgccttcgcctcgccgacccaggccgccgatgccagcaaggtgctcaatatcggctacgaaaacgacccggtgttccgcgtgctcgacggcacctcggcgacctggggcaccctgggcgtgcacgacggcgccaaggcctcggccaccaacaacatcgtcaacttcaacgatcactacgcctccgacgcctggaacctgctgccgttctccatcggcaacatcgccacctggctgtcgcacctgccgacggcctacgccgatggccttggccgggtgctggggtcgtcgttctatcaatggaccagccgcgactcgaccatcgtggtcagcaacctgtccgatgtcacccgtggctcgacctgggtcgaggacctcaaccgcaatgccgagccgcacaagggcagcaccttcatcatcggttccgagcaggacgacctgatccacggcgggcgcggcaacgactacctcgaggggcgggccggcaacgacaccttccgcgatgacggtggcttcaacctgatcgacggcggcgccggccatgacaccctgaagctgcaggacgccctggccaacctgagcatcgcccgggacggcgagggcatgctgtacgtgcgtgacgcccagggcggcatcagcctggtgcgcaatgtcgagaacctggtgagcaaggagtcgagcctgctgatcttcagcaaggaggtcagccacggggtcgcggcgcagggcctgttcgagagcggcaaggtcacgccctacgcatcgacgctcaatggcacccaggccggcgaccagctggtggccggcaaccagggccagtggctgtttggcctgggcggtgacgatcggctgcagggcggcgccggcaatgacgtgctggtgggtggcgcgggcaacgatgtgctcattggcggcgcggggcgcgacaccttcctgttcagcgagcatttcggccaggaccgggtgctggacttcaccgggcaggaccggctggtgttcattggcgtggacggtggtacggcggcgccggactggcgtgcccatgccagccaggttggcgatgacctggtactgaagttcggcggggacagcgtgacgctggtggggatctcggcccagggggtgggggatgggcagatcgtgattgcctga

SEQ ID NO: 162 - protein, 616 aa, Unknown
  Obtained from environmental sample
  DOMAIN (527)...(544): Hemolysin-type calcium-binding repeat (2 copies)
  DOMAIN (382)...(399): Hemolysin-type calcium-binding repeat (2 copies)
  DOMAIN (133)...(266): Lipase (class 3)
MPVFDYRQLDSTASSSLYKDAMALATYAYHGIDDGFSAGYQKHGFGLGLPATLVKALIGGTDSQGVIPGIPWNPDSEARALAQVKAAGWTPISAAQLGYQGKTDGRGTFHGEAPGYTSAQVEILGRYDAAGQLSGIGIAFRGTSGPRENLLGDTIGDAINDLLAAIGPAGYARDYAGNAFGQLLADVAAFAKANGLSGADVTVSGHSLGGLAVNSLADLSGSRWGGFYQDARYVAFASPTQAADASKVLNIGYENDPVFRVLDGTSATWGTLGVHDGAKASATNNIVNFNDHYASDAWNLLPFSIGNIATWLSHLPTAYADGLGRVLGSSFYQWTSRDSTIVVSNLSDVTRGSTWVEDLNRNAEPHKGSTFIIGSEQDDLIHGGRGNDYLEGRAGNDTFRDDGGFNLIDGGAGHDTLKLQDALANLSIARDGEGMLYVRDAQGGISLVRNVENLVSKESSLLIFSKEVSHGVAAQGLFESGKVTPYASTLNGTQAGDQLVAGNQGQWLFGLGGDDRLQGGAGNDVLVGGAGNDVLIGGAGRDTFLFSEHFGQDRVLDFTGQDRLVFIGVDGGTAAPDWRAHASQVGDDLVLKFGGDSVTLVGISAQGVGDGQIVIA

SEQ ID NO: 163 - DNA, 1854 bp, Unknown
  Obtained from environmental sample
atgggtgtgtatgactacaagaacttcggcacagcagactccaaggcgttgttcagcgacgccatggcgatcacgctgtattcctatcacaacctcgacaacggtttcgccaccggttaccagcaaaacggcttcggcctgggcttgccggcaaccctggtcaccgcgctgatcggcggcaccgattcccagggcgtcattcccggcattccctggaaccccgattcggaaaaggctgctctcgaagccgtgcaaaaagccggctggacgccgatcaccgccgcgcaattgggctatgacggcaagaccgacgctcgcggaaccttcttcggcgagaaggacggttacaccagcgcccaagtggagatcctcggcaagtacgacgcccagggtcatctcaccgaaatcggcatcgcttttcgcggcaccagtggcccgcgggaaatccagatcggcgactccatcggtgatgtgatcaacgacctgatggcagcgctagggccaaaggattatgcgaaaaactacgtaggtgaagccttcggcaatctgctcagtgacgttgcagcgtttgcccaggccaatgggctttcgggcaaggacgtactggtcagcggccacagcctcggcgggttggcggtcaatagcctggcggacttgagcagcgataagtggtccggtttttaccaggattccaactacatcgcctatgcctcgccgacccaaagcagcagcgacaaagtgctgaacatcggttatgaaaacgacccggtgttccgcgccctcgatggctcgtcgttcaacctggcctcggtaggcgtgcacgatgccgccaaggattcgacgaccgataacatcgtcagcttcaacgaccactacgcctcgacggcgtggaacgtgctgccgtattccatcctcaacatccccacctggatctcgcacttgcccaccggttacggcgacggcatgacccgggtgctggagtcgcagttctacgacctgaccagcaaggattcgaccatcatcgtcgccaacctctcggacccggcgcgcagcaacacctgggtccaggatttgaaccgcaacgccgaaacccataaaggcagcaccttcatcatcggcagcgacggcaatgacctgatccagggcggcaagggcagcgactacctggaaggccgcgacggtaacgacaccttccgcgatagcggcggctacaacatcctgttgggcggcaagggcagcaacgtgctggacctgcaggagtcggtgaagaactttgtcttcgccaatgacggtgccggcaacctgtacgtgcgcgacgccaatggcggcatcagcatcactcgcgacatcggcagcatcgtcaccaaagagccgggttttctctggggggtgttcaaggatgacgtgacccacagcgtcaccggcaatggccttgtgaccggcagcaacctgacccagtacgcctcaagcgtgaagggcacgaccggcgccgacaccctcaatgcgcacgcaaccggcgactggatgtttggcttcgatggcaacgaccatttgatcggcagcaccggcaacgacgtgtttgtcggcggggcgggtaatgacctgctggtatcaggcggcggggtcgacacgttcctgttcagcggggcgtttggccaggatcgggtggtgggctatcaagccaatgacaaactggtattcctaggggttcagggcgttgcgccgaacgatgactaccgggcccatgccacggcggtagggcaggatacgttgctgacgtttggcagtgattcggtgaccctggtgggtgtcgggctggacagtttgtccggtggggggattgtaatcgcctga

SEQ ID NO: 164 - protein, 617 aa, Unknown
  Obtained from environmental sample
  DOMAIN (133)...(265): Lipase (class 3)
MGVYDYKNFGTADSKALFSDAMAITLYSYHNLDNGFATGYQQNGFGLGLPATLVTALIGGTDSQGVIPGIPWNPDSEKAALEAVQKAGWTPITAAQLGYDGKTDARGTFFGEKDGYTSAQVEILGKYDAQGHLTEIGIAFRGTSGPREIQIGDSIGDVINDLMAALGPKDYAKNYVGEAFGNLLSDVAAFAQANGLSGKDVLVSGHSLGGLAVNSLADLSSDKWSGFYQDSNYIAYASPTQSSSDKVLNIGYENDPVFRALDGSSFNLASVGVHDAAKDSTTDNIVSFNDHYASTAWNVLPYSILNIPTWISHLPTGYGDGMTRVLESQFYDLTSKDSTIIVANLSDPARSNTWVQDLNRNAETHKGSTFIIGSDGNDLIQGGKGSDYLEGRDGNDTFRDSGGYNILLGGKGSNVLDLQESVKNFVFANDGAGNLYVRDANGGISITRDIGSIVTKEPGFLWGVFKDDVTHSVTGNGLVTGSNLTQYASSVKGTTGADTLNAHATGDWMFGFDGNDHLIGSTGNDVFVGGAGNDLLVSGGGVDTFLFSGAFGQDRVVGYQANDKLVFLGVQGVAPNDDYRAHATAVGQDTLLTFGSDSVTLVGVGLDSLSGGGIVIA

SEQ ID NO: 165 - DNA, 309 bp, Unknown
  Obtained from environmental sample
atggaacgctgccatgacatagtgcatcaccctctcgctgtcggcgagaaacgaaatatgacggcgccatttgatgtacgccttgatgagcaggcggactatgaacaggcgaagcatgtcgtgcaaccagatatctccgtcatttgcgatcaaagccaaattggcagccgaggctgcgatggtccgcctgacttggtagtggaagtgctttcgccaagtacagcgttgaaagatcgaaacgaaaagtatatgttgtacgaacagtttggcgtcaaggaatattggatcgtggatccaaagaattcaaaa

SEQ ID NO: 166 - protein, 103 aa, Unknown
  Obtained from environmental sample
MERCHDIVHHPLAVGEKRNMTAPFDVRLDEQADYEQAKHVVQPDISVICDQSQIGSRGCDGPPDLVVEVLSPSTALKDRNEKYMLYEQFGVKEYWIVDPKNSK

SEQ ID NO: 167 - DNA, 936 bp, Unknown
  Obtained from environmental sample
atggatccacaggtgcaggctctcctccaggtgatggaggcccaggcacaggcgacgggtgctcccccgctgtgggaacaggacccggcggtcgcccgggcgcaggcggaactcgggttcgctgccttcaacgcaccgatgcccctgaccgtggcgatcgaagacaggaagatcccaggtccgggcggcgaggtcggtctcaaggtgttcacgccgcagggcgaagggccgttcccgctgttggtttatatccacggcggcggctgggtcatcggtagcgcggccacccacatgaagctctgcgcggagctcgcggagggggccgactgcgtggttgccagcgtcgattaccggctggcgcccgaataccccgcgccggctgcgctcgacgactgcatggcggccattcgctgggcggtcgaacacgccgccgaactcagggcggacggcggacggttcgcgatcggtggcgattcggccggcgggaacctcacggctgcggcctgcctgcggctgcgcgacgagggcggtccccggccgcgcctccaactactcctctacggcgccttccatcacaacgtggatacgccgtcggcgatagcgaacggggagggctacatccttacccgccaggcgatgatctggttctggaaccactacctttctggcggcgccgacgagcgcgatccgtacatctccccggcctacggagacctcagtggtctgccgccggcccatttcattgtcgggacgctggaccctctcctggacgactcgaagctgtacgcgaagaagcttcaagaggcgggagtgccggcgacgctctccatctacgaagacatgccgcacgtgtttctgcagctttcgtcggtgattgacggcggcaagcgcggagtggcggaggcctgtgaagcgttgaagtcggccttcgcgtga

SEQ ID NO: 168 - protein, 311 aa, Unknown
  Obtained from environmental sample
MDPQVQALLQVMEAQAQATGAPPLWEQDPAVARAQAELGFAAFNAPMPLTVAIEDRKIPGPGGEVGLKVFTPQGEGPFPLLVYIHGGGWVIGSAATHMKLCAELAEGADCVVASVDYRLAPEYPAPAALDDCMAAIRWAVEHAAELRADGGRFAIGGDSAGGNLTAAACLRLRDEGGPRPRLQLLLYGAFHHNVDTPSAIANGEGYILTRQAMIWFWNHYLSGGADERDPYISPAYGDLSGLPPAHFIVGTLDPLLDDSKLYAKKLQEAGVPATLSIYEDMPHVFLQLSSVIDGGKRGVAEACEALKSAFA

SEQ ID NO: 169 - DNA, 933 bp, Unknown; identical to SEQ ID NO: 19
  Obtained from environmental sample

SEQ ID NO: 170 - protein, 310 aa, Unknown; identical to SEQ ID NO: 20
  Obtained from environmental sample
  SIGNAL (1)...(24)
  DOMAIN (44)...(289): alpha/beta hydrolase fold

SEQ ID NO: 171 - DNA, 735 bp, Unknown
  Obtained from environmental sample
atggaagcgaaaaccgtacagacgccgcatgtgcccgtccgctacttcgagggcgggaaaggcgagcccctcgtcttcctgcatggcgcgggcggcattaccgccgaagacccgttccttgcgaagctcgcggagacatatcacgtctacgcgccgctgctgccgggctatggcgactcggaggaatgcggcgagttgcgcgagatgctcgacatcacgctccacacatgggacgtcgtcgaagcgctcggccttaagaacccgatccttgtcggccattcgatgggcggcatgatcgcggcggagatggccgccgtcgcgccgaacgacgtgtcgcgcctcgggctcatctgcccggcgggactctggctcgacgagcatcccattcccgacatcttcgcgatgctgccatacgagcttccggcggttctcttccacgatgtggaagccggcacggcgctgatgacggcgggcgtcgcgctcgacgatccggaatggctgaagggcttcctcgtccagaatgcgcgccaactcggcatggcggggaaaatcctcttccccgtgccggatcgcgggctctcgcaacggctctaccgcgtgaaggcgaagacggtgctcgtctggggcgacggcgacaagctgatcgtgcctgcctatgcccatgcgtggaagaaggcgatcaggcaagcggaactcgtctcgatcccggaggcgggccacctgatgacgctctaa

SEQ ID NO: 172 - protein, 244 aa, Unknown
  Obtained from environmental sample
  DOMAIN (47)...(244): alpha/beta hydrolase fold
MEAKTVQTPHVPVRYFEGGKGEPLVFLHGAGGITAEDPFLAKLAETYHVYAPLLPGYGDSEECGELREMLDITLHTWDVVEALGLKNPILVGHSMGGMIAAEMAAVAPNDVSRLGLICPAGLWLDEHPIPDIFAMLPYELPAVLFHDVEAGTALMTAGVALDDPEWLKGFLVQNARQLGMAGKILFPVPDRGLSQRLYRVKAKTVLVWGDGDKLIVPAYAHAWKKAIRQAELVSIPEAGHLMTL

SEQ ID NO: 173 - DNA, 1578 bp, Unknown
  Obtained from environmental sample
atgagatcagcagctcgcatcagcgtggcggcagttgcctttctttgcctgctcttgacgactcgggtttccgcccagatcgtgccggcgatggaatgtgcggatctggcgaatcagcagcttcccaacacgacgatcacctcggcccagaccgtcaccaccggatcgttaacgcccccgggctcgacgaatccgatcaccgacctgcctcctttctgccgtgtcacaggcgccatcgccccgacgagcgagtcgcacatcctcttcgaggtctggctgccgctggataaatggaacggcaagttcgccggcgtgggcaacggcggctgggccggcatcatctccttcggcgccctcggaagccagctcaggcgcggctacgcgaccgcctccacgaatacgggtcacgaagcggcgccggggatgaacgcagccaggtttgcgttcgagaagccggagcagcttatcgacttcgcctatcgctcccagcacgagacggccctgaaagcgaaggcgctggttcaggctttctacgggaagccgccggaacactcctatttcatcgggtgctcatcgggtgggtaccagggcctgatggaggcccaacgatttccggccgactacgacgggatcgtcgccggtatgccggcgaacaactggacacggctgatggccggcgacttggacgcgatccttgccgtctccgtagatcctgccagccaccttcccgtctccgcattgggtctgttgtatcgctcggtgctcgctgcctgcgacggcatcgacggtgttgtagacggtgttctggaggatccgcgccgatgccggttcgacccggccgtgttgatgtgcaaggcggatcagaatcccgatggctgccttacgccggctcaggtggaagcggcacggcgcatatacggcggtctgaaggatcccaagaccggcgctcagctctatccggggctggcgccgggaagcgagccgttctggccgcaccgcaatccggcgaatccgttccctattccgatcgcgcactacaagtggctcgtctttgccgatccaaactgggattggagaacattcaagttcacggatccggcggactaccaggctttcctcaatgcggaagccacgtatgcccctactctcaatgcgaccaatccggacctccgggagttcagccggcgcggcggcaggttgattcagtaccatggctggaacgatcagctgattgccccgcaaaacagcatcgactattacgagagcgtcctttcgttcttcgggtccggcaaacaggatcgagcgcagaccgtgcgcgaggttcagagcttctaccggctgttcatggcgccgggtatggctcactgtggaggcggtacaggtccgaactcatttgacatgctggatgccctcgagaagtgggtggaaggcgggatagcgccggaacgagtccttgcgacgcgttccataaacggcgtagtcgaccggctgcgcccgctctgtccatatccgcaggtcgccgtgtacaagggtcatggggatacaaacgacgccgcgaacttcgtctgtcgcgattag

SEQ ID NO: 174 - protein, 525 aa, Unknown
  Obtained from environmental sample
  SIGNAL (1)...(25)
MRSAARISVAAVAFLCLLLTTRVSAQIVPAMECADLANQQLPNTTITSAQTVTTGSLTPPGSTNPITDLPPFCRVTGAIAPTSESHILFEVWLPLDKWNGKFAGVGNGGWAGIISFGALGSQLRRGYATASTNTGHEAAPGMNAARFAFEKPEQLIDFAYRSQHETALKAKALVQAFYGKPPEHSYFIGCSSGGYQGLMEAQRFPADYDGIVAGMPANNWTRLMAGDLDAILAVSVDPASHLPVSALGLLYRSVLAACDGIDGVVDGVLEDPRRCRFDPAVLMCKADQNPDGCLTPAQVEAARRIYGGLKDPKTGAQLYPGLAPGSEPFWPHRNPANPFPIPIAHYKWLVFADPNWDWRTFKFTDPADYQAFLNAEATYAPTLNATNPDLREFSRRGGRLIQYHGWNDQLIAPQNSIDYYESVLSFFGSGKQDRAQTVREVQSFYRLFMAPGMAHCGGGTGPNSFDMLDALEKWVEGGIAPERVLATRSINGVVDRLRPLCPYPQVAVYKGHGDTNDAANFVCRD

SEQ ID NO: 175 - DNA, 864 bp, Unknown
  Obtained from environmental sample
atgaagctcgttttcggcgcgctggcgctcgccctcgtcggcagcggcgcctcgctggcgccggcccagacgaatgcggtgtcggtgcccgcgccgaagccttttgcctcgacgcgcttttcggtcgaggtgaccgggaccggccccgacgttatcctcatccccgggctcactgcctcgcgggaagtgtggcggggcagcgtcaatgccgtgccgggctaccgctatcacctgattcaggtggcgggcttcgccggcactcccgcgcgcggcaacgcgcagggggcggtcgtcgcgccgctcgcggacgagattgcccgctacatagccgccaagggtctgcagcgcccggcgctggtcggccactcgatgggcggtacgctggcgatgatgattgccgcccggcacccctcgcgcgtcggcaaggtgatggtggtcgacatgctcccgcagccggccggcatcctcggttcctcggcggggggaatgcgcggcctcgccgacacgctgcgcaacatcagcgcctctcccggcggacgccggctggtcgaatcggccattcgcctgttcggcaatgagcaggccgaaggcacgcgcagcgatcccgatgtcgtcgcgcgcgccacccacgagctcgccgtccttgaccttacgccggagctgccgaggatccgcgctccgcttaccgtgctctacgcctccctcgacgagacccgccgcgccacgaccgaccgcgcctacgccgccggctatgccccgaggcccggcgcgaagctgatccggatcgacgggagcggccacatgatcatgtacgatcagccggcgaagttccgctccgcgctgaaggccttcctcgccaattaa

SEQ ID NO: 176 - protein, 287 aa, Unknown
  Obtained from environmental sample
  DOMAIN (74)...(283): alpha/beta hydrolase fold
MKLVFGALALALVGSGASLAPAQTNAVSVPAPKPFASTRFSVEVTGTGPDVILIPGLTASREVWRGSVNAVPGYRYHLIQVAGFAGTPARGNAQGAVVAPLADEIARYIAAKGLQRPALVGHSMGGTLAMMIAARHPSRVGKVMVVDMLPQPAGILGSSAGGMRGLADTLRNISASPGGRRLVESAIRLFGNEQAEGTRSDPDVVARATHELAVLDLTPELPRIRAPLTVLYASLDETRRATTDRAYAAGYAPRPGAKLIRIDGSGHMIMYDQPAKFRSALKAFLAN

SEQ ID NO: 177 - DNA, 798 bp, Unknown
  Obtained from environmental sample
atgttcccacgtgtcataaatatcacggtgcttctgcttgtgtctgcaggcagcaccttcgcgcaatccaccgcgccctcgacgcaagccgacacgcgcggcaggctgtatctgattcatcttcccggcatcggcgggttgatgcgaatcgaccggctgctgaccagcggcctgaccaacggcggcatcgacgctgagatcaccatttacgactggaccaacggcaatcccggcctgcccgcgctgggcgcgctggagcgcaacaagaccgaggcaaagaaagtcgctcagatgatcatcgatcgactcgaggccgagccggaagcgaagatcattctgacctgccacagcggcggggcgggcatcgcagtgtgggcgctggagagccttcccgagagcgtgcggatcgacacgctgctcatgctggcgccggcgctgtcgccacagtacgatctcagcgcagctttgcggcgtgtgaagaatcacgcctattcattcaacagcgaattcgacccgattctcggcccgggaacccgcaccttcggcacgatcgaccggataaggaccgacgcggcgggaaaagtcggctttgaggttcccgaccaggctgacgcggcgcagtatgccaagctggtgcagattccttatgaccggcagtggatgtcgctgggccatgccggcgagcacatcggtccgatgatgcccaggttcgccgcgcgggtgatcgcgccgctgctgctgaatggcgagctgccgcagccgacgacgcagccggcgagcacggttcccgctcgatga

SEQ ID NO: 178 - protein, 265 aa, Unknown
  Obtained from environmental sample
  SIGNAL (1)...(21)
MFPRVINITVLLLVSAGSTFAQSTAPSTQADTRGRLYLIHLPGIGGLMRIDRLLTSGLTNGGIDAEITIYDWTNGNPGLPALGALERNKTEAKKVAQMIIDRLEAEPEAKIILTCHSGGAGIAVWALESLPESVRIDTLLMLAPALSPQYDLSAALRRVKNHAYSFNSEFDPILGPGTRTFGTIDRIRTDAAGKVGFEVPDQADAAQYAKLVQIPYDRQWMSLGHAGEHIGPMMPRFAARVIAPLLLNGELPQPTTQPASTVPAR

SEQ ID NO: 179 - DNA, 924 bp, Unknown
  Obtained from environmental sample
atgactctattgttaggggttttcgtaccgctgcagccatcacatgctactgaaaattatctaaatgattttaaactgttgcaacataatgtatttttattgcctgaatcagtttcttattggggtcaggacgagcgtgcagattatatgagtaatgcagattacttcaagggacatgatgctctgctcttaaatgagctttttgacaatggaaattcgaacatgctgctaatgaacttatccacggaatatccatatcaaacgccagtgcttggccgttcgatgagtggatgggatgaaactagaggaagctattctaattttgtacccgaagatggcggtgtagcaattatcagtaaatggccaatcgtggagaaaatacagcatgtttacgcgaatggttgcggtgcagactattatgcaaataaaggatttgtttatgcaaaagtacaaaaaggggataaattctatcatcttatcagcactcatgctcaagccgaagatactgggtgtgatcagggtgaaggagcagaaattcgtcattcacagtttcaagaaatcaacgactttattaaaaataaaaacattccgaaagatgaagtagtatttattggtggtgactttaatgtgatgaagagtgacacaacagagtacaatagcatgttatcaacattaaatgtcaatgcgcctaccgaatatttagggcatagctctacttgggacccagaaacgaacagcattacaggttacaattaccctgattatgcgccacagcatttagattatatttttgtggaaaaagatcataaacaaccaagttcatgggtaaatgaaacgattactccgaagtctccaacttggaaggcaatctatgagtataatgattattccgatcactatcctgttaaagcatacgtaaaataa

SEQ ID NO: 180 - protein, 307 aa, Unknown
  Obtained from environmental sample
  DOMAIN (24)...(306): Endonuclease/Exonuclease/phosphatase family
MTLLLGVFVPLQPSHATENYLNDFKLLQHNVFLLPESVSYWGQDERADYMSNADYFKGHDALLLNELFDNGNSNMLLMNLSTEYPYQTPVLGRSMSGWDETRGSYSNFVPEDGGVAIISKWPIVEKIQHVYANGCGADYYANKGFVYAKVQKGDKFYHLISTHAQAEDTGCDQGEGAEIRHSQFQEINDFIKNKNIPKDEVVFIGGDFNVMKSDTTEYNSMLSTLNVNAPTEYLGHSSTWDPETNSITGYNYPDYAPQHLDYIFVEKDHKQPSSWVNETITPKSPTWKAIYEYNDYSDHYPVKAYVK

SEQ ID NO: 181 - DNA, 1014 bp, Unknown
  Obtained from environmental sample
gtggcggtggctcgccatcctgctggagccaagcccgcccaaaactcgatcggaggtgccgtgatggccctggacccgcaagcgcagatggttctcgacctcgtcctcaactcgggacggccgccctaccaccagctgtcgccgaaggacgctcggcagatgttccgcgagacccgcccggcgtcgaccccgacgccgccggcgattggcgccgtccgcgacgaggtcgcgaacacggcctcggggccgatcccgctgcgggtgtacaggcccgccggcgcggcgccggatgctgctctccccgggctcgtcttcttccacggcggcggctgggtgatcggcgacctcgatacccatgacgtgctctgccgccagctcaccgcggccgcggggctcaccgtcgtctccgtggattaccggctcgcgcccgagcacccgttcccggccgcggtcgacgacgcctgggccgctatacgctgggtcgtcgagcgcgcgaactacctcgggatcgatgcgcgccagctcgccgtcggcggggacagcgccggtggcaacctcgccgccgtcatgacgctgctcgcgcgtgatgcgggggcgccgtcgatcgcctaccaggtgctgctctatcccgtgaccgacgttggggccgaggcgccgtcgtatgaggccttcgccgatggctacctgttgacccgcacggggatgcgctggttcatcgagcactacctgccgtcccggcgcgacgccactgactggcgcgtctcgccgctgcgcgcgccctcgctcgcggggctgccgcccgccctgatcgtgacggccgggttcgatccgctctgcgaggagggagaggcgtacgcccgcgggctccgcgctgcgggcgtccgcgtggactacgtgtgctacggcggcatgatccacgggttcgtgcccatggggcgcctcatcgagacgggcaaccgcgccgtcgcacatatcgcggcctcgctgcgcgaggcccttcgcgcggccgggtga

SEQ ID NO: 182 - protein, 337 aa, Unknown
  Obtained from environmental sample
MAVARHPAGAKPAQNSIGGAVMALDPQAQMVLDLVLNSGRPPYHQLSPKDARQMFRETRPASTPTPPAIGAVRDEVANTASGPIPLRVYRPAGAAPDAALPGLVFFHGGGWVIGDLDTHDVLCRQLTAAAGLTVVSVDYRLAPEHPFPAAVDDAWAAIRWVVERANYLGIDARQLAVGGDSAGGNLAAVMTLLARDAGAPSIAYQVLLYPVTDVGAEAPSYEAFADGYLLTRTGMRWFIEHYLPSRRDATDWRVSPLRAPSLAGLPPALIVTAGFDPLCEEGEAYARGLRAAGVRVDYVCYGGMIHGFVPMGRLIETGNRAVAHIAASLREALRAAG

SEQ ID NO: 183 - DNA, 924 bp, Unknown
  Obtained from environmental sample
atggcttccattcaatctcgtattttcactgggttattgcgtattgcgtcaggctaccgctctcgaagcgatcgcacctccgcgcaaacagccgtgaacaagtcccgtgcctttacgcggctgatgaccttgccccagcttccgggaacgcgatccatccacgccgacattccgaaccttcgcgcaacgtggcatgtggggaagcacgtacgggacgatgtgcgcatcgtctatttccacggcggagcctataccgcagggtctgtcgcgacgcatcgacacttcacctcgatgctcgcaaaactcagccatatccccgtgctttctgtcgactatcgcctcgcaccagaacatccttttcctgcgggctttgatgatgcaattgccgcctatcaatgggccaaagagcacgggccagtaggaaagagcgaagcgcaacatatcgtaattgcaggtgattctgcgggcggaggcctcagtgcggcgatcgcgatgcaactgcgcgatgcaggacagctcctagacggcggcctcatgctgctttcgccgtggatggatctgacctgtagctccggcgcagaacatcgcatcggacatcttgatgccatgctcaatgcggaccacgcgcgtatcatggcgagtctttacgcaggaacccatgacttgaccgacccacgactttcgccgctttatggagactttgcgggtcttccgcccatgttcgtcgccattggcggacgagaaatcgtgctcgatgaggtggttcatgcccttgaaaaagcgcgcgcagcgggcgtggaagttaccctcgaacgtaatgaagaaatgttccacgtttggccagtgatgttccatctcgtccccgaaggacgcgcaagcttagagcgcatggtcgattggctgaattggaagtttcctgcatag

SEQ ID NO: 184 - protein, 307 aa, Unknown
  Obtained from environmental sample
MASIQSRIFTGLLRIASGYRSRSDRTSAQTAVNKSRAFTRLMTLPQLPGTRSIHADIPNLRATWHVGKHVRDDVRIVYFHGGAYTAGSVATHRHFTSMLAKLSHIPVLSVDYRLAPEHPFPAGFDDAIAAYQWAKEHGPVGKSEAQHIVIAGDSAGGGLSAAIAMQLRDAGQLLDGGLMLLSPWMDLTCSSGAEHRIGHLDAMLNADHARIMASLYAGTHDLTDPRLSPLYGDFAGLPPMFVAIGGREIVLDEVVHALEKARAAGVEVTLERNEEMFHVWPVMFHLVPEGRASLERMVDWLNWKFPA

SEQ ID NO: 185 - DNA, 1425 bp, Unknown
  Obtained from environmental sample
atgggtatctttgactataaaaacctcggtaccgaggactccaaggcgctgttcgccgatgccatggcgatcacgctgtattcctaccacaacctggataacggctttgccgtcggctaccagaacaacggcctcggcctgggcttgcccgccacgctggtcagcgcgctgattggcggcagcaacgcccaaggggtcatccctggcatcccctggaaccccgactcggaaaaggccgccctcgacgcggtgcagaaagccggctggacgcctatcagcgccagtaccctgggctacagcggcaaggtcgatgcgcgcggcaccttctttggcgaaaaattcggctacggcacggcgcaggccgaggtgctgggcaagtacgatgacgctggcaagttgttggaactcggcatcagttttcgcggcacttcggggcctcgggaaagcgtggtcaccgactccatcggcgacgtgatcagcgacctgctcgccgccttcgggcccaaggattatgccaagaactacgcgggggaagcctttggcggcttgctcaagaacgtggcggactacgccagcgcccacggcctgagcggcaatgacgtcgtggtcagcggccacagcctgggggggctggcggtcaacagcatggccgatttgagcgacagcacctggtcggggttttataaggactccaactacgtggcctatgcttcgccgacccaaagcgccggcgacaaggtgcttaacgtcggctatgaaaacgacccggtgttccgcgccctggatggctcgtcattcaacctgtcgtccctgggcgtgcacgacaaaccccacgaatcgagcaccgacaacatcgtcagcttcaacgaccactacgcctcatccctgtggaacgtgctgccgttttccatcctcaacctgcccacctgggtctcgcacttgcccaccggttacggcgacggcatgacccgcatcctcgattcgggcttctacgagcagatgacccgcgactccacggtgatcgtcgccaacctgtccgaccctgcacgggccaccacctgggtgcaagacctcaaccgcaatgccgaggcgcacaagggcaataccttcatcatcggcagtgacggcgacgacctgatcaaaggcggcaggggcgcggactttattgaaggcggcaagggcaatgacacgatccgcgacagcagcgggcataacacgtttttgttcagcgggcagtttggcaacgaccgggtgattggctatcaggcgacggacaagctggtgttcaacgacgtggcgggcagcaccgattaccgcgatcacgccaaagtggtgggcggggataccgtcattagctttggtacggattcggtgacgctggtgggtgtgagcagtctgtcgggggaggggatagtcatcagctaa

SEQ ID NO: 186 - protein, 474 aa, Unknown
  Obtained from environmental sample
  DOMAIN (133)...(265): Lipase (class 3)
MGIFDYKNLGTEDSKALFADAMAITLYSYHNLDNGFAVGYQNNGLGLGLPATLVSALIGGSNAQGVIPGIPWNPDSEKAALDAVQKAGWTPISASTLGYSGKVDARGTFFGEKFGYGTAQAEVLGKYDDAGKLLELGISFRGTSGPRESVVTDSIGDVISDLLAAFGPKDYAKNYAGEAFGGLLKNVADYASAHGLSGNDVVVSGHSLGGLAVNSMADLSDSTWSGFYKDSNYVAYASPTQSAGDKVLNVGYENDPVFRALDGSSFNLSSLGVHDKPHESSTDNIVSFNDHYASSLWNVLPFSILNLPTWVSHLPTGYGDGMTRILDSGFYEQMTRDSTVIVANLSDPARATTWVQDLNRNAEAHKGNTFIIGSDGDDLIKGGRGADFIEGGKGNDTIRDSSGHNTFLFSGQFGNDRVIGYQATDKLVFNDVAGSTDYRDHAKVVGGDTVISFGTDSVTLVGVSSLSGEGIVIS

SEQ ID NO: 187 - DNA, 432 bp, Unknown
  Obtained from environmental sample
atgacagtacagcttgcgatgtataaaggtaaaggcggccccttcaatacgctggttcggtggtggacatcgagccagtacagccactgtgaactggtcatcgatggggtgtcctacagcagctcgctgatggatcgcggcgtcagggcaaaggtcatcgacttcaagcctgaacactgggacttcatcgagctgccctgggcggatgccgagaagattcgtgagtatttcatggtcactcagggtcagcggtacggaatcccaggtctcataaaatcgcaaatgctcaaccgcaacaaggagttcaagaactcacagttctgctctgagtggtgcgcccgtgcgttgggtattccatccggtggcatttacagcccggatacactgggcaagttgtgtggctgggtcagcggactgctgcacgcgacttaa

SEQ ID NO: 188 - protein, 143 aa, Unknown
  Obtained from environmental sample
MTVQLAMYKGKGGPFNTLVRWWTSSQYSHCELVIDGVSYSSSLMDRGVRAKVIDFKPEHWDFIELPWADAEKIREYFMVTQGQRYGIPGLIKSQMLNRNKEFKNSQFCSEWCARALGIPSGGIYSPDTLGKLCGWVSGLLHAT

SEQ ID NO: 189 - DNA, 774 bp, Unknown
  Obtained from environmental sample
gtgacctccacgcggagcatgctggcgggagtgccggtttacaccatcaccccgcaaaacctgcccactgcgaacgctgaccgcattctcctgcatttccacggcggcggctatgttctcggcccgggtgaggctggcacggatgaagccatcctgatggcgggcattgccgggtacaaggttatctccgtggactacaggatggcgccggatcatccgtacccggcggccatcgatgatgccgtcaccgtgtacaaagagctgctcaaattcgtaccggctcataaaatcggaattttcggcacttcaacaggcggcggcatgacccttattctggccctgcgcgccaaagcggaaggcttgtcgttaccaggcgctctggcggcgggcactccttggacggatttgaccaaaaccggcgacacttactacaccaacgagcacgtggacaacgttctggtcagctatgacggctgggtcggcgaagccgcgaaactctatgccgcggggcatgatttgaaagaccccatgctctccccagtatacggcgatgtttcgggctttccgccgatactgctcacctcgggcacgcgcgaccttttcctgagcaacaccgtgcgcatgcaccaaaaactccggcaagcgggagttgtggcggatctgatcgttttcgaaggtatgtcccactgccattattacttccttccagacgcgcccgaaacccgtttccactttacggaacttggcacatttttcggacgccatttacaatga

SEQ ID NO: 190 - protein, 257 aa, Unknown
  Obtained from environmental sample
MTSTRSMLAGVPVYTITPQNLPTANADRILLHFHGGGYVLGPGEAGTDEAILMAGIAGYKVISVDYRMAPDHPYPAAIDDAVTVYKELLKFVPAHKIGIFGTSTGGGMTLILALRAKAEGLSLPGALAAGTPWTDLTKTGDTYYTNEHVDNVLVSYDGWVGEAAKLYAAGHDLKDPMLSPVYGDVSGFPPILLTSGTRDLFLSNTVRMHQKLRQAGVVADLIVFEGMSHCHYYFLPDAPETRFHFTELGTFFGRHLQ

SEQ ID NO: 191 - DNA, 882 bp, Unknown; identical to SEQ ID NO: 47
  Obtained from environmental sample

SEQ ID NO: 192 - protein, 293 aa, Unknown; identical to SEQ ID NO: 48
  Obtained from environmental sample
  SIGNAL (1)...(35)
  DOMAIN (53)...(259): Lipase (class 2)

SEQ ID NO: 193 - DNA, 1848 bp, Unknown
  Obtained from environmental sample
atgggtgtctacgactacaaaaaccttactactgaggactccaaagcactgttcgccgatgccatggcgatcacgttgtactcctaccacaacctggataacggctttgccgtgggctaccagcagcatggcctggggcttggcttgccggtgaccctggtgcaggcgttgctgggcagcgccgactcccagggcgtgatccccggtatcccatggaaccccgactcggaaaaggccgccctcgacgcggtgcaaaaggccggttggacccccatcagtgccagcaccctcgactacggcggcaaggtcgatgcccggggcaccttctttggtgagaaaaccggctataccagtgcccaggtggaagtcctgggcaaatacgatgacgccggcaaactgctggaaatcggcatcgccttccgtggcacctcggggcccagggagaacctgattgttgattccatcggcgatgtgatcagcgacttgctggcagccttcggccctgcggactatgcgaaaaactacgcgggccaggcgtttggcgacttgctcggcaaagtcgccgcgtatgcccgcgcgcaggggctcagtggccaggatgtactggtcagcggccatagcctcggtggcctggcggtcaacagcatggccgacttgagcaacaccacctgggcgggtttctataaggacgccaactacgtggcctatgcctcgctgacccagagcagcggcgacaaggtgttgaacatcggttatgaaaacgacccggtctatcgcgccctcgacggttcgtcgttcaacctgtcgtccctcggggtgcatgaccaaccgcatgcctccagcgccgataacatcgtcagcttcaacgaccactacgcctcgacgctctggaacatcctgccgttttccatcctcaacctgccgacgtggatttcccatttacccacgggttatggcgatggcatgagccgcatcctcgaatccaagttctatgacctgaccagccgtgattcgacgatcatcgtcgccaatctgtcggacccggcgcgcgccaacacctgggtgcaggacctcaaccgcaatgccgaagcccaccagggcagtacgttcattatcggcagcgacggcaatgacctgatccagggtggccggggcaacgactacctggaaggtcgcgctggcaacgataccttccgtgatggcggcggctacaacatcctgctgggcggcaaggggttcaacaccctggacttgcagcagtcgctgaaaaacgtcgaagtggccaacgatggcgcaggcaccctgtacatccgcgacggccaaggcggtatcagcatgacccgcgatatgggcgcgatagtgagcaaggaaagctatctgttgctgttcagcaaggaggtgacccacagcgtgaccgacaaggggttgctggcgggcaaggacctgaccgcctacgcggcgtcgctcaagggcgatgccggcgccaatgttctcaaggccggcgatagcgggcagtggttgtttggcctggacggcaatgaccacctgatcggcggtaaaggcaacgatgttctggtgggcggggccggcaatgacctgctggaagcgggtggcgggcgcaataccttcctgttcgacggcgacttcggccaggaccggatcctgggttaccagtcgacggacaaattggtatttatgggcgtggcgggggtggacgggcagtacaactacctcgaccatgccaaggcagtgggcagcgatacgctgctgaccttcggcgataactcggtgacgctggtgggggtagggctgggcagcctgtcggcggaggcgttcgtgattacctga

SEQ ID NO: 194 - protein, 615 aa, Unknown
  Obtained from environmental sample
  DOMAIN (508)...(525): Hemolysin-type calcium-binding repeat (2 copies)
  DOMAIN (133)...(265): Lipase (class 3)
  DOMAIN (381)...(398): Hemolysin-type calcium-binding repeat (2 copies)
MGVYDYKNLTTEDSKALFADAMAITLYSYHNLDNGFAVGYQQHGLGLGLPVTLVQALLGSADSQGVIPGIPWNPDSEKAALDAVQKAGWTPISASTLDYGGKVDARGTFFGEKTGYTSAQVEVLGKYDDAGKLLEIGIAFRGTSGPRENLIVDSIGDVISDLLAAFGPADYAKNYAGQAFGDLLGKVAAYARAQGLSGQDVLVSGHSLGGLAVNSMADLSNTTWAGFYKDANYVAYASLTQSSGDKVLNIGYENDPVYRALDGSSFNLSSLGVHDQPHASSADNIVSFNDHYASTLWNILPFSILNLPTWISHLPTGYGDGMSRILESKFYDLTSRDSTIIVANLSDPARANTWVQDLNRNAEAHQGSTFIIGSDGNDLIQGGRGNDYLEGRAGNDTFRDGGGYNILLGGKGFNTLDLQQSLKNVEVANDGAGTLYIRDGQGGISMTRDMGAIVSKESYLLLFSKEVTHSVTDKGLLAGKDLTAYAASLKGDAGANVLKAGDSGQWLFGLDGNDHLIGGKGNDVLVGGAGNDLLEAGGGRNTFLFDGDFGQDRILGYQSTDKLVFMGVAGVDGQYNYLDHAKAVGSDTLLTFGDNSVTLVGVGLGSLSAEAFVIT

SEQ ID NO: 195 - DNA, 1071 bp, Unknown
  Obtained from environmental sample
atgacagcatttaatcaaaaaattcaaacattgctagaaaagggccaagggcctgctgctcgagctcttgataagttacctcgattagctcaagaatcacttgctaaaattcttggatattcttaccaatatcccgatctcgactcatttactaaatgtatgatggctgtacaaattaaacagggtcatatcggtttcattggttcagacccaattgaatctagaaggcagttcgatacgcaaatgctggctatacgccacaagtcaacagagatcgacttagtagaagatatccgtttacctctccaaagtggaaccgtttttgcgagacactatcacccagcaccgaataagaaattacctcttattgttttctatcatggaggaggatttgttgttggtggtttagatactcatgatgaggtttgtcgtatattggcaaaatatgcaaaagtacaagtcctcagtatcgattaccctctagcacctgaggtttctcctcagcatttaatccaatcttgtgaagatgctttagcttgggtatatcaaaatcgtagacagttaaaaatattaaaaggtcgaattgcggtagcgggggatagtgctggtggaaacattagtacagtcgtggctcaaagatcagtaaataaaccttatgctcctcaggcccaacttcttatttatcctgccgtcgatttcaagagtcgacatccttccttctatgcatataacgaaggattggttttaacggataacgatatcaataatgtcactcaatattatgcaacccagcataacgtagaactagatgatccaattatttctccaacttatggcaacttgaagaagaatcctccggcttttgtgattactgctgggcatgatgtattacatgatgaaggcaaaatttatagctataagctacgccaaaatggtgtcaaaatgcattatgaagaatattcagatcaaactcatggttttataaatttgacgcctatttccaaaaaagccaaacggtacaccattgagttcagtaaaaactttagaaaattttgggataaaaatagctaa

SEQ ID NO: 196 - protein, 356 aa, Unknown
  Obtained from environmental sample
MTAFNQKIQTLLEKGQGPAARALDKLPRLAQESLAKILGYSYQYPDLDSFTKCMMAVQIKQGHIGFIGSDPIESRRQFDTQMLAIRHKSTEIDLVEDIRLPLQSGTVFARHYHPAPNKKLPLIVFYHGGGFVVGGLDTHDEVCRILAKYAKVQVLSIDYPLAPEVSPQHLIQSCEDALAWVYQNRRQLKILKGRIAVAGDSAGGNISTVVAQRSVNKPYAPQAQLLIYPAVDFKSRHPSFYAYNEGLVLTDNDINNVTQYYATQHNVELDDPIISPTYGNLKKNPPAFVITAGHDVLHDEGKIYSYKLRQNGVKMHYEEYSDQTHGFINLTPISKKAKRYTIEFSKNFRKFWDKNS

SEQ ID NO: 197 - DNA, 1386 bp, Unknown
  Obtained from environmental sample
atgacagacgaactctggcgcaaatcagctcatgaactggcagccatgatcagtagtaagcaagtatccagtcgtgaggttgtgaccagtcacctcgagcgtatcgaggcgattaatccccgcgtcaatgcggttacggtgatcctggcggaatcagccctggcggcggcagacaaggcggacgccggtccaccgacgggcccgtttcatggcgtaccctttaccatcaaggaaaatattgattgcaccggttcggcgacaaccatgggtttgccggtctttgccgaaaccctgcccgtcgcggatgcaccagtggttgcgcgcatgaaagccgctggtgcgattccacttgccaggacgaatctaccggaaatgggtctgcggatcaccacggacaacccgctccggggccgaacgaacaatccctgggatatcactcgaactgcaggaggctcaagtgggggggagggggccaccctggcgacgggtatgagccccatcggtttgggtaacgatatcggtggctccctgagaaatcccgcttattgttgcggtattgcagctttgaaacccacaacgggcagaattccctttgtgccctcgataccggctgcgccccaacccaattcgttcaggctgatgtgcgtagagggtccaatggcaagatcggtcgctgacctggatatcgcctatcgtgtcctgtcgggttggcacccacaagacccttactcagtgcccgcggcactgcagggccctgtggtggccaggacagtagcgcttgtcacccggatgccggatttgacactccctgctgccacggtagcggcaattcaccaggccggggagcatctcagggcagcggggtggcaggtcgaggaggtcacgcctccggaactggctcgggtgaacgagatttgggctcgagtgctgggctccgacatccgcaataccttgcccttattggcacccatcatgagtgaaggcgccgtgggagcgttgacgcggtttctggatgaattcgatccggcagcgatgagcggcacgcaggtgtatgccgagcgagatcgcctcgcggtggcctggtcggcgttttttcaggaacactcgctggtaatcgggcccacctgggcagatttaccgtttctccatgacgcggacctcgatcccgaaaccggtattgagaccctccagcgccggctgcaattcattacccccggtaacttgctgggcctgcctgcggtcgcgttacccacgggtgtagtcgatggcttgccgaccggtgtgcagatctatgctgatcgctggcgggaagacttgtgcctggaggccgccgggactatcgaggcccgggtgggtcatatcaccccgattgacccgaagttctag

SEQ ID NO: 198 - protein, 461 aa, Unknown
  Obtained from environmental sample
  DOMAIN (26)...(441): Amidase
MTDELWRKSAHELAAMISSKQVSSREVVTSHLERIEAINPRVNAVTVILAESALAAADKADAGPPTGPFHGVPFTIKENIDCTGSATTMGLPVFAETLPVADAPVVARMKAAGAIPLARTNLPEMGLRITTDNPLRGRTNNPWDITRTAGGSSGGEGATLATGMSPIGLGNDIGGSLRNPAYCCGIAALKPTTGRIPFVPSIPAAPQPNSFRLMCVEGPMARSVADLDIAYRVLSGWHPQDPYSVPAALQGPVVARTVALVTRMPDLTLPAATVAAIHQAGEHLRAAGWQVEEVTPPELARVNEIWARVLGSDIRNTLPLLAPIMSEGAVGALTRFLDEFDPAAMSGTQVYAERDRLAVAWSAFFQEHSLVIGPTWADLPFLHDADLDPETGIETLQRRLQFITPGNLLGLPAVALPTGVVDGLPTGVQIYADRWREDLCLEAAGTIEARVGHITPIDPKF

SEQ ID NO: 199 - DNA, 1320 bp, Unknown
  Obtained from environmental sample
atgaaaatgaatttattgacaaaaacgattatcggtttatcggcggcaggcgcggcttatttatgggttaagaagcgaagtgaagccccgaatcgctttgagatcaaggggtttgtcagccatggctttgaggcggtcggcgaggcgttcgccgggaacttctccgagcgcggcgaactcggagcggcctgctgcatttatcaccgcggcgaaaaggtagttgacctttggggcggtgtgcggaacgagaaaacgggcgaaccctgggaagaggatacgatggtgatagtttattcggcaaccaagggcatggccgcgatggctctagccgttgctcattcccgtggttggctcgattacgatgcgcctgtctgcaaatactggccggagtttgcccggaacggaaaggaaaaaattaccgtccggcagcttcttgcccatcaagccgcgctttttgccttcgatgagccggttgatgcgagcgtggtcgccgatctcgaccgtctggcggaggtcatggcgcggcagaaacccgaatgggaaccgggaacgcggcaggcttatcacgccatcacgctcggattttacgaaagcgaactgctccgccggatcgatccgcagcaccggagtttgggacgattctttcaggacgagatagcttctccgctcgggctggatttttacatccgtctgcccgaatcaattcccgattcgagattggcaacgcttaaagctccgacctttttcgagaggatattcggtttccccattcagatgactctggccgctttcgatcaccggtccatcgtgtaccgggcgcttattgcgaatccgggagccgccatctgtcatgatgaccggcgcatctacgcccgcgagcttgaagttccgtcaggcggcggcgtcggaacggcacgggcgatagcttacgcctacagcgtttttgccaccggagggcgggaactgcagcttcgtaaagagactctcgatgagttgacggccccggcgattccggcggcgaacggtttttacgacgagttcatgaatggcgaagtagagttttcgctcggctttatgaagtccggcccgggtttgtctttcggtcgcccgggttccttcggcgcgcccggagcaggcggttcgatcggctttgccgatcccgcgtcagagatcggatacgcctacgtcaccaacggaatgagcgtgaaattaaccggcgatccgcgggaccttgcgctcagacaggcgttgtattcgtcaacgccggcgcagatcattcggaatagaattgatccgaatcgagggtcgaaaaatcattaa

SEQ ID NO: 200 - protein, 439 aa, Unknown
  Obtained from environmental sample
  DOMAIN (50)...(416): Beta-lactamase
MKMNLLTKTIIGLSAAGAAYLWVKKRSEAPNRFEIKGFVSHGFEAVGEAFAGNFSERGELGAACCIYHRGEKVVDLWGGVRNEKTGEPWEEDTMVIVYSATKGMAAMALAVAHSRGWLDYDAPVCKYWPEFARNGKEKITVRQLLAHQAALFAFDEPVDASVVADLDRLAEVMARQKPEWEPGTRQAYHAITLGFYESELLRRIDPQHRSLGRFFQDEIASPLGLDFYIRLPESIPDSRLATLKAPTFFERIFGFPIQMTLAAFDHRSIVYRALIANPGAAICHDDRRIYARELEVPSGGGVGTARAIAYAYSVFATGGRELQLRKETLDELTAPAIPAANGFYDEFMNGEVEFSLGFMKSGPGLSFGRPGSFGAPGAGGSIGFADPASEIGYAYVTNGMSVKLTGDPRDLALRQALYSSTPAQIIRNRIDPNRGSKNH

SEQ ID NO: 201 - DNA, 1032 bp, Unknown
  Obtained from environmental sample
atgcgcctgaacgtttttttgcgccccttggtctgtttgagtctgcttggccttgccgcctgcggcagcaatccccccagccccgcagcgacacccgagccgcccacagcaaccacatcagcccccccgatcaagatcggcctggcgctgggcggcggtgcggccaagggctttgcccatatcggcgtcatcaagatgctcgaggccaatggcctcacgccctcgttcgtggccggcaccagcgccggcagcgtggtgggcgcgctctatgcgagcggcatgagcgccttcgagctacaggaaaaagccgtggcgctggacgaagccaagatccgcgacctgcagctgtccgctggcggtctggtactgggccagaagctcgaagactatgtgaatgaacaagtccaccgcaagccgctggagcagatggccaagccctttgttgccatctccacgcgcctggaggacggcgaacgcacggtgttcgcacgtggcaacgtgggccaggcagtgcgcgcctccagcagcgtgcccggcgtgtttcagcccgtcaccatcggcaagtaccactatgtggacggcggcattgtcagccccgtgccggtggatgcagtacgcaatctgggggccgacatcgtgatcgccgtggatatctccaacaaggccagcggcaagaccccggccaatatgctgggagcgctcaatcagtcgattgccatcatgggccagaagctgggtcaggccgagctggcgcgagccgatatcatcattcgccccaaggtgctggacatcggcccggccgacttcgcgcagcgcagccatgcgattgtggaaggcgagaaggccgccactgcactgatgccgcagattcgcgaacgcatcgcgcagctgcgcgccgaacgcgccaaggccactcaggtagcgcagcaaaaggccgccgaagccagctatcaggactgcctgaagcagcgctccagccttcaaaagctgtccggcatggtgggcatgagcggcaactgcgaaaagccctga

SEQ ID NO: 202 - protein, 343 aa, Unknown
  Obtained from environmental sample
  SIGNAL (1)...(29)
  DOMAIN (48)...(206): Patatin-like phospholipase
MRLNVFLRPLVCLSLLGLAACGSNPPSPAATPEPPTATTSAPPIKIGLALGGGAAKGFAHIGVIKMLEANGLTPSFVAGTSAGSVVGALYASGMSAFELQEKAVALDEAKIRDLQLSAGGLVLGQKLEDYVNEQVHRKPLEQMAKPFVAISTRLEDGERTVFARGNVGQAVRASSSVPGVFQPVTIGKYHYVDGGIVSPVPVDAVRNLGADIVIAVDISNKASGKTPANMLGALNQSIAIMGQKLGQAELARADIIIRPKVLDIGPADFAQRSHAIVEGEKAATALMPQIRERIAQLRAERAKATQVAQQKAAEASYQDCLKQRSSLQKLSGMVGMSGNCEKP

SEQ ID NO: 203 - DNA, 1185 bp, Unknown
  Obtained from environmental sample
atggaaagcaaaaaaattgtaaataactatcctacggtctttgttcacggatatcttggtatgggatatgatgcagggcttacatcggtatatcggtattttggttcatttacaaaagatcttatgaaacatttaaaaggccaaggatatgaggtgtatcagccgactcttggagcatttagcccactttggaatcgttgttgtgatctttatgcctacatatttggtggtacggcagactatggaaaggtccatagtaggcgttatcaccaaaagagatatggtcgtacttatccaggtatacttaaagatttaggagaagaaggagaccataaaaaattaaatcttattggccactcttttggtggacctacggttacgctttttgctggcattcttgaacagggttgtaaggaagagttagaagctaccccagaagatgaagtatcagaatttttcaaaggtggaaaaggtgatcttcttcacacagtaactactctttctggtgttaacgctggcacttcagctgcggattttgcagaacattttcatctcatgggcctggtttccaagctatcagctggtctagtttcagctgtttcagaaactcaaattacaaagttccttgattttcatatggaggcttgggatcttatggaagagccttcaaaggtagatactcataaattcaaggttccagatatggctgcagtaaataggtatgcaaataataaagagggaaatatttattatgaaatgcatcctgaaataactagaaaacttttagccgattataaaccgaatccccatacatattattttgcgagaagagcttgtagaactcatgaaggtcctgggggacgtcagtatcctgacactaatatgaaccctttgttttttggaacggctcttattatgggtagatataagaatgaaagcataggtattgatgattcatggctttcaacagatggcattgtaaatgtaaaaggaatgggtgctccagatggacatccaagtattgagtggattcctggtatggagttcagaccaggtatatggcatgagatgccaatagaagataaggatcatcagtcttttgctggcatgtggtattttagaaatcgctattatctttattttgatgcgatgcttcacatgcttcatactttacctgatgcctaa

SEQ ID NO: 204 - protein, 394 aa, Unknown
  Obtained from environmental sample
MESKKIVNNYPTVFVHGYLGMGYDAGLTSVYRYFGSFTKDLMKHLKGQGYEVYQPTLGAFSPLWNRCCDLYAYIFGGTADYGKVHSRRYHQKRYGRTYPGILKDLGEEGDHKKLNLIGHSFGGPTVTLFAGILEQGCKEELEATPEDEVSEFFKGGKGDLLHTVTTLSGVNAGTSAADFAEHFHLMGLVSKLSAGLVSAVSETQITKFLDFHMEAWDLMEEPSKVDTHKFKVPDMAAVNRYANNKEGNIYYEMHPEITRKLLADYKPNPHTYYFARRACRTHEGPGGRQYPDTNMNPLFFGTALIMGRYKNESIGIDDSWLSTDGIVNVKGMGAPDGHPSIEWIPGMEFRPGIWHEMPIEDKDHQSFAGMWYFRNRYYLYFDAMLHMLHTLPDA

SEQ ID NO: 205 - DNA, 1278 bp, Unknown
  Obtained from environmental sample
atgtatgcatttttaaaaaagctatcaagcaagttattaataataccttttttggtggtgtttttagctactccagcatttgcaaaggaaagtaaacaatatagtagagcttcaattaacaataactatccaattatattagtgcatggatttatgggatgggggcgtgacgaagttttaggatttaagtattggggtggatttaatgatattcaagaagctttaagaaaaaagggatttaaggtgtatacagcttctgttggacctatttcaagtaattgggatagagcatgtgaactttatgcctatattaggggggggagagttgactatggagaagctcattcaagaaaaaatggacacctaagatatggtaagtattatccaggagtatatgaaaaatggggtataaaagataataaaggaaatattaaaaaggttcaccttttaggacatagtatgggtggtcaaactattcgtacattagtacaattactagaagagggctcacaagaagaaagaaatgttacgaaaaatgatactttatctccattgtttaaaggagacaaaagttgggtatttagtataactactatttcaactccacatgatggaagtagtcttggagataaaaataattattatatagacaaatatggtcaaaagatagtttgtgctttagcatcagtaacaggaaacgtaaaagattttgtatatgattttgatttagagcaatggggacttaagagaaaatcaaatgaaagtatacttagttactcaaatagagtatggagtagcaaaatatggaacacgaatgatgtatcaagatgggatctttcaccacagggtgcaagagaattaaataaatgggttaaagcacaacctgacgtgtattatttttcttggacaactaaggcaacaagaagtttaccaatgacaggaaaagttgttgcagatccaatatatatgaatccagtattgattcctacagcaacatttattgctcatcatacaaataatgaaggtggaattaatatagattctaagtggtttcataatgatggagctgtaagtgttataagtgctaatggtcctaagttaggctcaaatgataaaataacagagtatgattcaagaaaatctcctaaaaaaggagaatggacgcatatgggtataatcgataaaacagatcatatggatattgtaggaattggaaatattagagatttgacaggtttttattcaaatatagcaaaacaattaacatatttacaataa

SEQ ID NO: 206 - protein, 425 aa, Unknown
  Obtained from environmental sample
  SIGNAL (1)...(28)
MYAFLKKLSSKLLIIPFLVVFLATPAFAKESKQYSRASINNNYPIILVHGFMGWGRDEVLGFKYWGGFNDIQEALRKKGFKVYTASVGPISSNWDRACELYAYIRGGRVDYGEAHSRKNGHLRYGKYYPGVYEKWGIKDNKGNIKKVHLLGHSMGGQTIRTLVQLLEEGSQEERNVTKNDTLSPLFKGDKSWVFSITTISTPHDGSSLGDKNNYYIDKYGQKIVCALASVTGNVKDFVYDFDLEQWGLKRKSNESILSYSNRVWSSKIWNTNDVSRWDLSPQGARELNKWVKAQPDVYYFSWTTKATRSLPMTGKVVADPIYMNPVLIPTATFIAHHTNNEGGINIDSKWFHNDGAVSVISANGPKLGSNDKITEYDSRKSPKKGEWTHMGIIDKTDHMDIVGIGNIRDLTGFYSNIAKQLTYLQ

SEQ ID NO: 207 - DNA, 786 bp, Archaea
atggctgaaatatataaagccaatttcggaacccccgagcggggctgggtggttcttgtccacggcctcggaaagcacagcgggaggcacggaaggctgattaaagagctcaacgatgccggcttcgctgtctatgcctttgactggcccggtcacgggaagagccccggcaagagggggcacaccagcgttgaagaggctatggaaataattgattctataattgcagaaataggtgagaagcccttcatcttcgggcacagcctcggcggcctaaccgtaatacgctacgccgagacgaggcccgacaagatacgcggcctcgtggcctcctcgcccgccctcgccaagagcccggaaacgtctggcttcatggtggccctcgcaaagttccttggaaaaatagccccaggaatagtgctctccaacggcattaatccaaacctgctttccaggaatcccgaggcggttaaacgttacattgaagacccccttgtccacgacaggatttcggccaagctcggaaggagcatcttcgtgaacatggagctggcacacatggaagcagatagaataaaagcccctgtcctgctcctcgttggcactggcgacgtcataacgcccccggagggggcaagaaaactctttgaagagctcaaaatagaggacaagacgcttaaagagtttgagggggcctaccacgagatattcgaagacccagagtgggctgacgagttccacaggacgataatccagtggctggttgagggggcctcccggagctag

SEQ ID NO: 208 - protein, 261 aa, Archaea
  DOMAIN (42)...(252): alpha/beta hydrolase fold
MAEIYKANFGTPERGWVVLVHGLGKHSGRHGRLIKELNDAGFAVYAFDWPGHGKSPGKRGHTSVEEAMEIIDSIIAEIGEKPFIFGHSLGGLTVIRYAETRPDKIRGLVASSPALAKSPETSGFMVALAKFLGKIAPGIVLSNGINPNLLSRNPEAVKRYIEDPLVHDRISAKLGRSIFVNMELAHMEADRIKAPVLLLVGTGDVITPPEGARKLFEELKIEDKTLKEFEGAYHEIFEDPEWADEFHRTIIQWLVEGASRS

SEQ ID NO: 209 - DNA, 858 bp, Unknown
  Obtained from environmental sample
atgaaaaagtccgtactcatttttttatttttcatcgcctcggggagtatgagtgcggtctttttctatcacagtagtgatacagaagataaatcaatagaagtggcacaatcgcagcaagacacggaagtcgacaggcaatcaccaaaagcactgctggaatatttcatgtcaggtgtcggggaagtgaccttattggatattgaaaaacagatcagctcacaagatcatgaggtgaatggtattgcggtagataaagcgttatttgaccaatacgtgttatataaaaaagccatgatggctttagaaaataccgatgggccttcgctgtcattaacggcacttgaggggttacatcgtcaaattttagctcttcaagctgaatttttcactttcgagcagcagttattattgtttgaaaaagaaaaccaactgcgtcaattagcattggtaaagctacaattaacgcaaaatagttcgagtaatgatgacttcgaacatcaatggcagcaagaattgtctaatatgcctgcttatatacaagaaagttttgaaaacgcagaattactgacgaaattagctcaaacagaccaactttcggagcaagagaaacaattaaagcgtgaggcactggtgggagtggaagccagtgaacgcttagcgaccttagagcaacaacgagcacgttttcaattccaagttgatgagtatttctccatacgaagcaccattctagaagattcaacattatcggaggaaggaaagaaaaatgcgattctcctattacaagcggatcttttttctacagaacagctaaagcgcattgcggccttagaacgaatgcatgatagacaatga

SEQ ID NO: 210 - protein, 285 aa, Unknown
  Obtained from environmental sample
  SIGNAL (1)...(18)
  DOMAIN (17)...(284): Proteobacterial lipase chaperone protein
MKKSVLIFLFFIASGSMSAVFFYHSSDTEDKSIEVAQSQQDTEVDRQSPKALLEYFMSGVGEVTLLDIEKQISSQDHEVNGIAVDKALFDQYVLYKKAMMALENTDGPSLSLTALEGLHRQILALQAEFFTFEQQLLLFEKENQLRQLALVKLQLTQNSSSNDDFEHQWQQELSNMPAYIQESFENAELLTKLAQTDQLSEQEKQLKREALVGVEASERLATLEQQRARFQFQVDEYFSIRSTILEDSTLSEEGKKNAILLLQADLFSTEQLKRIAALERMHDRQ

SEQ ID NO: 211 - DNA, 1266 bp, Unknown
  Obtained from environmental sample
ttgcaaaacaaaataataaatacaaaaatcaaactaaggaaatttatgtctcaactaataaaaataacttacatttttataataattatattttgtatgcaacggacgtatgctaatcattgtgataattattttgaattaaaaacgcaaggcaatagaattgttgatcaatgtggagatacatttaaactaaaaagtgtaaattggtatggtgctcacgactatgcagaagttgttggaggtttagataagcaaccgatatcgacaattattagcttgataaaaagaggtggttttaattcggtacgattaaccttttcaaatcaaatgttgcatcgaactacatttgtagatacaaaatttatcagtgcaaatccagtattagctaacaagactccattgcaaatatttgattacgttgtaaatgaactaactaaggaagggattattgttattttaaataatcatacaacaacatcaacatggtgttgcggttacgatgttaatggaatttggaatcatccttatacgcaaactacatctcaatggataaatgattgggtcatgttagccgagcattttcgtaataatccgttggttgcgggaatggatttacgcaatgaggttcgtactactcgatattataattcttatattcccgtatttcctaattggggattgaatgatcataatgactggaagttagcttctacagaagttggaaatatgatccatgcggtgaatcctaaggtgcttattattgtagaagggttaaattgggtgggtgtaccaatgattaatggtcatcggcccatgcttaagccaattcgcgaaaatcctattcatttaaaaatttcgaataaattagtttatgaaatccataactatgcgtataccggacctacccatactggtgatgggaaggtttctcgatgggatatacgatatgaggatatggatgaagttactcttaataaaacgtgggatgaagaatttgggtttattttaaaaaatgataaagagtatacggcaccagtttggttaggcgaatttggtattggaataactgcaactgaaaaaggtaaggtatggtttcatcgaataatatcttatcttattaaacacgaaatgggatgggcatattgggcattaaatgcaactcgtgcaaatgggtctatagaatcttttggattactcaatgatgattggagtgactatcggcaagattggcgtacaaatgaaatgaagcgacttactaataattag

SEQ ID NO: 212 - protein, 421 aa, Unknown
  Obtained from environmental sample
  DOMAIN (52)...(392): Cellulase (glycosyl hydrolase family 5)
MQNKIINTKIKLRKFMSQLIKITYIFIIIIFCMQRTYANHCDNYFELKTQGNRIVDQCGDTFKLKSVNWYGAHDYAEVVGGLDKQPISTIISLIKRGGFNSVRLTFSNQMLHRTTFVDTKFISANPVLANKTPLQIFDYVVNELTKEGIIVILNNHTTTSTWCCGYDVNGIWNHPYTQTTSQWINDWVMLAEHFRNNPLVAGMDLRNEVRTTRYYNSYIPVFPNWGLNDHNDWKLASTEVGNMIHAVNPKVLIIVEGLNWVGVPMINGHRPMLKPIRENPIHLKISNKLVYEIHNYAYTGPTHTGDGKVSRWDIRYEDMDEVTLNKTWDEEFGFILKNDKEYTAPVWLGEFGIGITATEKGKVWFHRIISYLIKHEMGWAYWALNATRANGSIESFGLLNDDWSDYRQDWRTNEMKRLTNN

SEQ ID NO: 213 - DNA, 855 bp, Unknown; identical to SEQ ID NO: 127
  Obtained from environmental sample

SEQ ID NO: 214 - protein, 284 aa, Unknown
  Obtained from environmental sample
  DOMAIN (63)...(265): Lipase (class 2)
MALVVDDEDFAFRFDHGHHGIRRAGRPVPLRLRAASLILTLVLTAALLAGITTAPPAEATTGRNPVLLVHGLTADSLSWLVFKARLERDGFRVFTVDIPDRGFGDIARNSQYVAAKVDEIRRVTGAAKVDVIGHSEGGLLARHYIKYRGGADQVGRYISLGTPQYGTVLANFSTVFNLASLVGCVACYQMTTGSSFLANLNSGDDTPGPVKYTTIYTVYDELVQPYWNAALGNQPVTNVKIQSICPNRVVGHIGLVLDGTTYQIARAALRDQTPSWSNVNCWAL

SEQ ID NO: 215 - DNA, 783 bp, Unknown
  Obtained from environmental sample
atggaagaacagaaatttagaacaggttttattcttagcggaggtggtgcaagaggatttgcacatctgggatttatccaggctctgaatgaggctggtatctttccggatgtaatatctggaaccagcgccggagctcttatcggtgtatttattgctgacggttattctccgaaggaaatcctcagattattgcataccaacagccgcctcgattttatgagaccaacgatgccaagggaaggactgcttcagatttcgggaatccaaaaaatactaaaggcaagccttcatgctacaaagtttgaagaacttaaaattccgttgtatgttacagcgtccgatataaataacgggaaagtcgtctacttttctaaaggagacctcctcgatatagtcattgcctcaatgagcattcctgtactatttcaacctgttatgattgataatattcagtatgtggatggaggtgtgttcgataaccttcctgttcatccaatcgaaaataaatgtgagactcttatcggctctttcgtaaatcctgtcggccgtattgacaaattaagcggcctgataaatattgcagaacggactttcacactgaacatggcaaaggaagttaccgagaaatcagataaatttgacttgcttgtagctcctcccgctttgagaaattatggaatacttgatcctgataaagcagaagaacttttttccctgggatataatgcaacccgggagaaactcagggataatgaaatcaaaaaggcattaaaattgtaa

SEQ ID NO: 216 - protein, 260 aa, Unknown
  Obtained from environmental sample
  DOMAIN (10)...(168): Patatin-like phospholipase
MEEQKFRTGFILSGGGARGFAHLGFIQALNEAGIFPDVISGTSAGALIGVFIADGYSPKEILRLLHTNSRLDFMRPTMPREGLLQISGIQKILKASLHATKFEELKIPLYVTASDINNGKVVYFSKGDLLDIVIASMSIPVLFQPVMIDNIQYVDGGVFDNLPVHPIENKCETLIGSFVNPVGRIDKLSGLINIAERTFTLNMAKEVTEKSDKFDLLVAPPALRNYGILDPDKAEELFSLGYNATREKLRDNEIKKALKL

SEQ ID NO: 217 - DNA, 849 bp, Unknown; identical to SEQ ID NO: 75
  Obtained from environmental sample

SEQ ID NO: 218 - protein, 282 aa, Unknown; identical to SEQ ID NO: 76
  Obtained from environmental sample
  SIGNAL (1)...(23)

SEQ ID NO: 219 - DNA, 891 bp, Unknown
  Obtained from environmental sample
atggcaagtgaagcactgacgatgatcgtgaacttgttgcgcagccagcgcccgttgcaggaaccgacggtggaacaaatgcgtgcggggttggaggcgatggcgcaaatgtcgccgctacctgcggacgtggaattgaccaccgtggacgcaggaggtgtgcctggtgcctgggtgcgcgtgcccgagagcgaccccgaccgcgtcgtgctgtaccttcatggaggagggtacgtcattgggtcgattcggacacatcgcgaccttgctcagcgaattgcccgcgctgcccgttgccgtgtgttgttgatcgactaccggctcgcacccgaacacccgcatccggccgcggtggaagactcgacgcgagcgtaccgatggctcctcgagaccggaagcgcccccaaacgcatggccattgccggcgattcggccggcggcgggctgacggtggcgacactggtcgcactgcgagacgcgggagtgcccctgcccgctgccgccgtatgcttatcgccttgggtcgacttggagggaatcggcgagtcgatgaccacgaaggccgcagtcgatccgatggtccaacgagagccgttgctccgcatggcgtcgatgtacctggcgggtcaggacccgcgcacgcctctggcggctccgttgtacgccgacttgcgagagctgccgcccttgttgattcaggtgggtactgcggaaacccttctcgacgactcgatgcgcctggctgagcgcgcacgcgctgcgggcgtacaggtgacgctcgaaccttgggaagacatgattcacgtatggcaggcgttcgcggcaatgcttcccgagggccagcaggcgatcgagcggattggcgagtttttacgccagcattggcagtaa

SEQ ID NO: 220 - protein, 296 aa, Unknown
  Obtained from environmental sample
MASEALTMIVNLLRSQRPLQEPTVEQMRAGLEAMAQMSPLPADVELTTVDAGGVPGAWVRVPESDPDRVVLYLHGGGYVIGSIRTHRDLAQRIARAARCRVLLIDYRLAPEHPHPAAVEDSTRAYRWLLETGSAPKRMAIAGDSAGGGLTVATLVALRDAGVPLPAAAVCLSPWVDLEGIGESMTTKAAVDPMVQREPLLRMASMYLAGQDPRTPLAAPLYADLRELPPLLIQVGTAETLLDDSMRLAERARAAGVQVTLEPWEDMIHVWQAFAAMLPEGQQAIERIGEFLRQHWQ

SEQ ID NO: 221 - DNA, 1008 bp, Unknown
  Obtained from environmental sample
gtgtcgcaggatagggagtcgttgctgttgcggcaggccacggaggccggcatgacttcgtcccgggaactggccaacttcatggcgcaggccgggcatgaatcccgtggcttgagccgtctcaacgagagtttcaacttcacccggggcatctcgcagatcccggtggaagcagcgtggcgcaatggcaacggtgcgctggagagcgcccgtcaggacgcgctgcgtggccgcccggacaacctggctgagctgatgtacggcgggcgcatgggcaacgatgcccctggcgacgcactgaagtatcacggccgcggctatctgccgctggtcggcaaggagaactatgagcgtgccggcaaggcgctggaactggacctggtgaatcacccggaactggccgcgcagcccgagcacgcaggtcgcattgccgtgtggcagtggcagacgcgggtgccggaggcggcacgcgaggatgtgcgcgaagccacgcgtgccctgaatggcgcgctcaacggcatcgaagcccgccagcagcgttttgacgtgtggcaacagaagctgacccccgatgtgatggcgcgcctggagcgctgcgaagtgggggcgcctgcccagcaggcaacgggacgcgacatgtcgcaaccgggcgagccgggatacacgctgttctcgggagcgcgccagcacctgcagcagatggggccgcaaagcggtctgcgcagcgtgcaggaactggacaatgctgccggcgcactggcgctgagcgcgcagaaggcggggatgtcgcgcatcgatcatctactggccggcaacgacggccgcacgttgtttgccgtgcagggcgcgctgggtgacccagccatgctgcgcgcatcggtcgatcgcgaacaggcggcgcagcagccgctggcgcagagcagccagcagttggccgccagcgtcgcccagcaggaccccgcggccgcgctcgcccgcgagcaggagcagcgctctcgatccctgtag

SEQ ID NO: 222 - protein, 335 aa, Unknown
  Obtained from environmental sample
MSQDRESLLLRQATEAGMTSSRELANFMAQAGHESRGLSRLNESFNFTRGISQIPVEAAWRNGNGALESARQDALRGRPDNLAELMYGGRMGNDAPGDALKYHGRGYLPLVGKENYERAGKALELDLVNHPELAAQPEHAGRIAVWQWQTRVPEAAREDVREATRALNGALNGIEARQQRFDVWQQKLTPDVMARLERCEVGAPAQQATGRDMSQPGEPGYTLFSGARQHLQQMGPQSGLRSVQELDNAAGALALSAQKAGMSRIDHLLAGNDGRTLFAVQGALGDPAMLRASVDREQAAQQPLAQSSQQLAASVAQQDPAAALAREQEQRSRSL

SEQ ID NO: 223 - DNA, 1359 bp, Unknown
  Obtained from environmental sample
atgaagaaactggccgggcagctgtctgttgccctgttgtcgacagcaatgttggcgggttatgtgccgcaggcccaggcggcccagccggcggtgatttttgtgcacggcttcctcggcttttgcgaggatgaggcattgggttacaaatactggggcggtctggataatgtgccggcacagctggctgctgcctacccggacatgccggtatattcggtgtgcgtcggtccggtaagctcgaattacgaccgtgccgtcgagctgttctggaagatcaagggcggttgtatcgattacggcggcgcacacgccgcgacccatggccatgatcgctatttcaagaattcggcggcgccgcgtaataccgctgacacccgccagtgcccgagcccgaccgcggccgaagtgaagaacaaggccgtgtatccgacctgggatgaggcgcacccggtacatatcatcgcccatagccaaggcggacagaccgcgcggattctggcgcagctgctggccaacggtggccagagcccggaaggcgacaccggcctgtttggcggcaacgcggtgaacgcgcgctggatcaagagtattaccaccatctccacgcccaatgatggcaccaccttgtcggatgcaattaccgactatgtgccgttcgtacaatcgctggtcggcggcctggcaacctttgtcggcgccaatccgctgctgaccgattttgcctacgacttcaagctggatcagtgggatatccccaccaagagcggttcggaaagctattcggattacatgtaccgggtgctcaacaacaatccgaagaagatctttaccgacaagaatgtgcgcgatatcagtactttcgacctgtcgcccgatggcgcgatgcgcaccaacgactgggtagccgattcgccggacatctattacttctcgtggagcactcgtgccaataccaatggctggatcagcggctgggcttacccgcgctgggattccaacccgctgatcggcctgttctgcggccctggcttcatgggcaattttacccgcagcggcgcaccgtcgatcgactcctcgtggtgggacagcgattgcgtggtgccgaccaaggcgcagaaagccccgactcagcgcatttcgcgcaccgcaccgctgggcaccgcgcccacttcgcgtagcgtggtcatcaaggacatcagcgctggcggtacaccgcagaagggtgcctggaactggcgcggcctgatggacacctacgatcacctcgatatcgtcggctggacgcttggttggtcatcaaccgacaagctgaactggtacaaggcgcacatcaatcaactgcgcgcattgccataa

SEQ ID NO: 224 - protein, 452 aa, Unknown
  Obtained from environmental sample
  SIGNAL (1)...(27)
MKKLAGQLSVALLSTAMLAGYVPQAQAAQPAVIFVHGFLGFCEDEALGYKYWGGLDNVPAQLAAAYPDMPVYSVCVGPVSSNYDRAVELFWKIKGGCIDYGGAHAATHGHDRYFKNSAAPRNTADTRQCPSPTAAEVKNKAVYPTWDEAHPVHIIAHSQGGQTARILAQLLANGGQSPEGDTGLFGGNAVNARWIKSITTISTPNDGTTLSDAITDYVPFVQSLVGGLATFVGANPLLTDFAYDFKLDQWDIPTKSGSESYSDYMYRVLNNNPKKIFTDKNVRDISTFDLSPDGAMRTNDWVADSPDIYYFSWSTRANTNGWISGWAYPRWDSNPLIGLFCGPGFMGNFTRSGAPSIDSSWWDSDCVVPTKAQKAPTQRISRTAPLGTAPTSRSVVIKDISAGGTPQKGAWNWRGLMDTYDHLDIVGWTLGWSSTDKLNWYKAHINQLRALP

SEQ ID NO: 225 - DNA, 1209 bp, Unknown
  Obtained from environmental sample
atggaaatccatggtacatgcgacccaaagtttcacttggtgcggcaggagtttgaacgaaatttgcgtgagcgcggcgaagtaggagcgtccgtttgcgtcacgttgcacggcgaaaccgtagtggacttgtggggcggcatggcgcgtgccgacactcagacgccatggacggcggagacggtcagtattgttttttcctccaccaaaggcgcaacggcactctgcgcccatatgctggcgtcacgcggccaactggatcttgatgcaccagtcgccacctactggccggaatttgcccaagccggcaaagctcgcatcccggtgaaaatgctcttgaaccatcaagctggtctccctgccgtacggacaccgctgccccagggtgcctacgctgactgggaactgatggtcaatacgttggccaaggaagagccgttttgggaacctggcacccgcaacggctatcatgcgctcaccatggggtggctggtgggagaagtggtgcgacgtgtctctggtaagtcgcttgggacattcttccaagaggagatcgccaggccgttggggttagatttctggattggcttaccagcagagcaagaggcacgggtcgcgccgatgatcgcggcggagcctgatccgcaaagcctcttcttccaagaggtcgcgaagcctggggccttacagtcgctcgtactccttaactccggcggctatatgggtgctcagcctgagtatgactcgcgggcggcgcatgcggccgagattggtgcagccggtggtatcaccaacgcacgcggcctggcaggcatgtacgcaccactggcctgcggaggcaaactcaaaggggtggagttggtcagtcctgacatgctggcccgaatgtccagagtggcctctgcgactgggagagatgccgtgctcatgatgccaacccggtttgccctgggcttcatgaagtccatggacaaccgccgggagcctgctggcgtgcaggacagcgcgctctttggggaggaggcttttggccatgtgggggccgggggttcgtttggttttgccgatcccaaagcaggaatgtcctttggctataccatgaaccgaatggggctgggagccgggctcaacccgcgggggcaaagcctggtggatgcaacctaccgctcgttagggtatcagtcggatgcctctggagcctggacctga

SEQ ID NO: 226 - protein, 402 aa, Unknown
  Obtained from environmental sample
  DOMAIN (18)...(386): Beta-lactamase
MEIHGTCDPKFHLVRQEFERNLRERGEVGASVCVTLHGETVVDLWGGMARADTQTPWTAETVSIVFSSTKGATALCAHMLASRGQLDLDAPVATYWPEFAQAGKARIPVKMLLNHQAGLPAVRTPLPQGAYADWELMVNTLAKEEPFWEPGTRNGYHALTMGWLVGEVVRRVSGKSLGTFFQEEIARPLGLDFWIGLPAEQEARVAPMIAAEPDPQSLFFQEVAKPGALQSLVLLNSGGYMGAQPEYDSRAAHAAEIGAAGGITNARGLAGMYAPLACGGKLKGVELVSPDMLARMSRVASATGRDAVLMMPTRFALGFMKSMDNRREPAGVQDSALFGEEAFGHVGAGGSFGFADPKAGMSFGYTMNRMGLGAGLNPRGQSLVDATYRSLGYQSDASGAWT

SEQ ID NO: 227 - DNA, 1266 bp, Unknown
  Obtained from environmental sample
atgaacaagatgtttagcaaaaagggcgcttgcctggcggtagcggcggcgttgatgagcctaggcggggttgcgcaagcagccaacagttacccggtaattctggttaacggctatgccagctttgaccgtagcgaagccatgggtttcaaatactggggcggtaaaaacgatctgcaggcgcaactgcgcaatgcctacagcggcgcgcagccgatctacacggtcgcgccgggcggcttcagctccaactgggaccgcgccgtcgagctgtattatcagatcaagggcggctgcgtcgattatggcgctacccacgccactgcctttggccacacccgcgccggccgctgctataccggcgtctatccaagctggagcgccaccagcccggtgcatctggttggccacggcatgggtggccaaaccgtacgcatgctggcgcaactgctggcaagcaacggctcgccgaagaatgccggcctgttcggcaccgctggcgtcaccagtgcctgggtcaagagcgtcagcaccgtcgctacacctaacgatggcacgaccctgcccgacgtaatcaaggatcacgtgccgtatattcagggttacatcgcacgcctggcacgcgaagccggtgctcgcaacgatctggccgacatgactttcgacttccggctggatcagtggggcattgcccagcgcggtagtggcgagagtttcggcacctatttcgaccgcgtgttgcgcagcaattactggtacaacaccaccaacgatcgcgcgtcttacgacatgagcccgaaaggtgcggcagacctcaactcgtgggtgggcacggtatccggcgtgtattatttctcctacagcagccgtgcttcgaaacagggaactgccaacacctaccagtacccgcgcggcgatgccaacaacctggtcagcttcttctgcggcccaggctatatgggcaactacacacgtaaccagactggttatccggtgatcgacagcacctggtgggaatccgactgcatcgtgccgaccaaggcgcaaaaagcaccgactgtcatgatgtccggcagcagcttcatctccaccggagtcgtcatcaacgacatcagcgccggcggcacgccgcaactgggcaaatggaactggaaagggctgaaggatacttatgaccatctggatatggtcggctgggtccccaacccgaatttcgatgcactgaccttctacaaaacccacatcgaccaactgcgcagcctgtaa

SEQ ID NO: 228 - protein, 421 aa, Unknown
  Obtained from environmental sample
  SIGNAL (1)...(27)
MNKMFSKKGACLAVAAALMSLGGVAQAANSYPVILVNGYASFDRSEAMGFKYWGGKNDLQAQLRNAYSGAQPIYTVAPGGFSSNWDRAVELYYQIKGGCVDYGATHATAFGHTRAGRCYTGVYPSWSATSPVHLVGHGMGGQTVRMLAQLLASNGSPKNAGLFGTAGVTSAWVKSVSTVATPNDGTTLPDVIKDHVPYIQGYIARLAREAGARNDLADMTFDFRLDQWGIAQRGSGESFGTYFDRVLRSNYWYNTTNDRASYDMSPKGAADLNSWVGTVSGVYYFSYSSRASKQGTANTYQYPRGDANNLVSFFCGPGYMGNYTRNQTGYPVIDSTWWESDCIVPTKAQKAPTVMMSGSSFISTGVVINDISAGGTPQLGKWNWKGLKDTYDHLDMVGWVPNPNFDALTFYKTHIDQLRSL

SEQ ID NO: 229 - DNA, 1281 bp, Unknown
  Obtained from environmental sample
atgaacacgactcgtgccctcaggcatgcggctgccgcatgcgcgttcctctcgctgggctccgcggcgctgcccgcgctggccgccaattcctaccccgtgatcctcgtgcacggcttcgccggcttcggccgcaacgagctgctgggctacaagtactggggcggcctgaacgacctgcaggagcaattgaaggccaagtactcgaaccagctcgtggccaccgcggtggtcggcccgttcagctcgaactgggaccgcgccgtcgaactgttctaccagatcaagggcgggtgcgtggactacggcgcgctgcactcggcggccaacggccactacgagcgccccgagagctactaccacaacggccgcacctgctaccccgggctgtatccggcctgggacgccagccaccccgtgcacctgatctcgcacagcatgggcggccagacctcgcgcatgctggtgcagttgctcgcggccaacggcgcgccgagcaatccgtcgctgtttccctattcggtgaacgcgaactggatcaagagcgtgacgaccatcgccacgcccaacgacggcaccacgctggcctaccgcatcaccgactgggtgccggtcgtgcagcagctggtcaccggcatcgccgacttcacgggcgccaccggcggcaacctggtctacgacttcaagctggaccagtggggcgtgggcgcgcgggccgccggcgagagcttcagcgcctacgtcaaccgcgtgacgagcagcccgctgtggaattcgggcgtcaaggacctgtcgccgtacgacctgtcgcccgcgggggcgatggccgagaacgactgggtcaaggaccagcccaacgtcacgtacttctcgtgggtgaccaactccagctacacgggcctgctcaccggctggtcctacccgaacgccgacaccaacccgctgatcgccgcgttcgcgggccccggcttcatgggcaactactaccgcgactcgcgcccgatgccgcccgtcgacgacagcacctggttccccagcgacgccgtcgtcaactcggtggcgcagaaggcgccgacctgggcgatgaacgcgtcgggcaccgtctacaagcgcccggtggtggtcaaggacctcagcaacggcggcacgccgcaggccggcgcgtggaactacaagggcacgctgggcggcttcgaccacctggacgccgtcggctggacggtgttctgggacagcctgtcatggtacaaggcgcgcgtcgacgagttgcgggcgctctga

SEQ ID NO: 230 - protein, 426 aa, Unknown
  Obtained from environmental sample
  SIGNAL (1)...(28)
MNTTRALRHAAAACAFLSLGSAALPALAANSYPVILVHGFAGFGRNELLGYKYWGGLNDLQEQLKAKYSNQLVATAVVGPFSSNWDRAVELFYQIKGGCVDYGALHSAANGHYERPESYYHNGRTCYPGLYPAWDASHPVHLISHSMGGQTSRMLVQLLAANGAPSNPSLFPYSVNANWIKSVTTIATPNDGTTLAYRITDWVPVVQQLVTGIADFTGATGGNLVYDFKLDQWGVGARAAGESFSAYVNRVTSSPLWNSGVKDLSPYDLSPAGAMAENDWVKDQPNVTYFSWVTNSSYTGLLTGWSYPNADTNPLIAAFAGPGFMGNYYRDSRPMPPVDDSTWFPSDAVVNSVAQKAPTWAMNASGTVYKRPVVVKDLSNGGTPQAGAWNYKGTLGGFDHLDAVGWTVFWDSLSWYKARVDELRAL

SEQ ID NO: 231 - DNA, 279 bp, Unknown
  Obtained from environmental sample
atgagaacagaaatgctaagtactcgtatagaccatgataccaaagttgcttttactagcatctgtgacgaaatgggtcttagtacatcacaagctattaaaatatttgcaaaagccgtgattaatcatggtggtattccatttgacttacgtgtacctcaaccaaatgaaacaacgatgtctgcaatgaatgaactcgttcaagatcatgggcataaagcaaaatctgtcgacgctatgcttactgagctaactgaaggcaaagttaagaatgtatag

SEQ ID NO: 232 - protein, 92 aa, Unknown
  Obtained from environmental sample
  DOMAIN (3)...(84): RelB antitoxin
MRTEMLSTRIDHDTKVAFTSICDEMGLSTSQAIKIFAKAVINHGGIPFDLRVPQPNETTMSAMNELVQDHGHKAKSVDAMLTELTEGKVKNV

SEQ ID NO: 233 - DNA, 651 bp, Unknown
  Obtained from environmental sample
atgttaggaaggtttttacagaaaaaaggctacacatcacatgcaccaatttatcgtggacatggagtagaaccagagaaattaattgaaacaagaccagaagattggtgggaagatgttgttgaggcatacgaacacttacaagatttaggctatgaagaaattgctgttgcaggcttatctatgggcggcgtactcggactgaaactagcgacagaacgtaaagtgaaaggtgtcataccaatgtgtgcaccgatgtattttgataataaaacgcaattgacacaaggtttcgagatgtttgcaaaacaatacaagcaattagagaaaaaagatgcagcaacaattgagcaagaggtagctgcaatcatggattcatcccaggaattatttgtcgatattaaagcggccattgaagatgtcagtaaaattgttgattgtgtgtatacaaatacatttgtcgttcaagctacaaaggatcaaatgatcaatccagaaagtgctaattatatttatgaccatgttgcgacagacgagaaaaaaatcaaatggtatgatgaatctggtcatgtcattacgatgggcaaggaaaaagaccaactacatgaagatatttacatgtttttagaaaacttaaattgggaacaataa

SEQ ID NO: 234 - protein, 216 aa, Unknown
  Obtained from environmental sample
MLGRFLQKKGYTSHAPIYRGHGVEPEKLIETRPEDWWEDVVEAYEHLQDLGYEEIAVAGLSMGGVLGLKLATERKVKGVIPMCAPMYFDNKTQLTQGFEMFAKQYKQLEKKDAATIEQEVAAIMDSSQELFVDIKAAIEDVSKIVDCVYTNTFVVQATKDQMINPESANYIYDHVATDEKKIKWYDESGHVITMGKEKDQLHEDIYMFLENLNWEQ

SEQ ID NO: 235 - DNA, 1335 bp, Unknown
  Obtained from environmental sample
atggccaaccccatcgtcatcatccacggctggagcgacgacttcggctcgttccgcaagctgcgcgacttcctctccaccaacctcggcgttccggcgaagatcctcaagctcggcgactggatctcgctcgacgacgacgtcggctacgccgacatcgcgatggcgctggaacgcgcgtggaaggcggagaaactgccgaccgcgccgcgttcggtcgacgtcgtcgtgcacagcaccggcgcgctggtggtgcgcgaatggatgacgcgctaccacgcgcccgaaaccgtgccgatccagcgcttcctgcacctggcgccggccaacttcggctcgcacctcgcgcacaagggccgctcgttcatcggccgcgcggtgaagggctggaagaccggcttcgaaaccggcacccgcatcctgcgcgggctggaactcgcctcgccctactcgcgcgcgctggccgagcgcgacctgttcgtggcgccgtcgaagcgctggtacggcgccggccgcatcctcgccaccgtgctggtcggcaacagcggctactccggcatccaggccatcgccaacgaggacggctccgacggcaccgtgcgcatcggcaccgccaacctgcaggcggcgcttgcgaaggtggtgttcccgcccggcccggtcgcgccggtggtgcagttccgcaacatcgcgggcgccaccgcgttcgccatcgtcgacggcgacaaccattccgacatcaccatgaaggacaagccgtcgaagaccggcatccgcgaggaactgatcctcggcgcgctgaaggtgcgcgacgccgacttccccgagaacgccgacggcgcgttcccgtggcaggcgaagctcgacgcgaaggccggtgcggccaaggtgtcttcgcccgggcgccagaacaccgtggtgcacctcaccgacagcttcggcgacgacgtcgtcgatttcttcttcgagttctggcgcagcgaacgcagcgacaaggtgttcgagcagcgcttctacaaggacgtcatcgacgacgtgcacgtgtacgacggcaacggcgcgtggcgctcgctcaacctcgacctcgacaagttcgaggcgctgcgcaaggacccgaagctcggcttcgagaaactgctggtcagcgtgttcgcctcgcccgcgaagaagggcgacgccaaggtcggctacagcaccgccaccggccgcgacatcggcgcctggcacgtcgaaggccgtgacttcgccaaggccttcacgccgcaccgcaccctgttcgtcgacatcgagatcccacgcatcgtcgacgacgcggtgttccggttccgggaatag

SEQ ID NO: 236 - protein, 444 aa, Unknown
  Obtained from environmental sample
MANPIVIIHGWSDDFGSFRKLRDFLSTNLGVPAKILKLGDWISLDDDVGYADIAMALERAWKAEKLPTAPRSVDVVVHSTGALVVREWMTRYHAPETVPIQRFLHLAPANFGSHLAHKGRSFIGRAVKGWKTGFETGTRILRGLELASPYSRALAERDLFVAPSKRWYGAGRILATVLVGNSGYSGIQAIANEDGSDGTVRIGTANLQAALAKVVFPPGPVAPVVQFRNIAGATAFAIVDGDNHSDITMKDKPSKTGIREELILGALKVRDADFPENADGAFPWQAKLDAKAGAAKVSSPGRQNTVVHLTDSFGDDVVDFFFEFWRSERSDKVFEQRFYKDVIDDVHVYDGNGAWRSLNLDLDKFEALRKDPKLGFEKLLVSVFASPAKKGDAKVGYSTATGRDIGAWHVEGRDFAKAFTPHRTLFVDIEIPRIVDDAVFRFRE

SEQ ID NO: 237 - DNA, 1095 bp, Unknown
  Obtained from environmental sample
ttgaccttatactatgtggtggggattttgtcccatagtccttacttgtattttccgttttactctttacgctttactctttacgttttactctttacgtctcaggttctcagtcatcaacgatcacaactctctcactcaataaggaggatcattataccactcgacccaaaagccaaagcgtttttagaccaggccgctgcggctggcgcgccagcactggacgcgcttcccgttcgagaagctcgcgaggcgattcgcggcctgtttgcggccataggagaaaaagaacccgtcaaacaaatagaagatcgcatgatccctggcccgggcggacagatgcctgtgcgtatgtatacgccggcaggtaccacgccttttcccgtcctcgtttatttccatggcggaggatgggtcctgggtgatctagaaactcacgatgcgacctgccgggcgctggcaaatgctgctggctgcatggtgatctcggttgactatcgtttggcgccggagcacaaattccctaccgctcccgaggattgctatgcggccaccaaatgggcagcgctgaatgcggcggctcttggcggagatccaaccaagattgccgttggtggcgatagtgccggagggaatcttgctgccgcagtggcacaaatggccagtgaccgtggggctccttcgctcgggtttcagttgctcatctatccagtgaccaattacgcgttcgataccgcctcataccgggcaaatgcggagggctacctgctcacaaaaagcgcgatggggtggttctggaaccattatctgcagaacgaaaccgatggccagaatccctatgcttcgcctttacgtggacaatatctgcgcaatctacccccagcacttgtcatcaccgcggagtatgacccgctccgcgacgagggagaagcgtatgcagcgcggctgcgcgaagcaggtgttgctgtcactcacactgactacaaaggcatgattcatggcctcttcagcatgaccaacgtagtcgatcaggcgaagcaagccatcaatgaagctggtgccgcactgaaggcagcgtttgcggcgaaacgataa

SEQ ID NO: 238 - protein, 364 aa, Unknown
  Obtained from environmental sample
MTLYYVVGILSHSPYLYFPFYSLRFTLYVLLFTSQVLSHQRSQLSHSIRRIIIPLDPKAKAFLDQAAAAGAPALDALPVREAREAIRGLFAAIGEKEPVKQIEDRMIPGPGGQMPVRMYTPAGTTPFPVLVYFHGGGWVLGDLETHDATCRALANAAGCMVISVDYRLAPEHKFPTAPEDCYAATKWAALNAAALGGDPTKIAVGGDSAGGNLAAAVAQMASDRGAPSLGFQLLIYPVTNYAFDTASYRANAEGYLLTKSAMGWFWNHYLQNETDGQNPYASPLRGQYLRNLPPALVITAEYDPLRDEGEAYAARLREAGVAVTHTDYKGMIHGLFSMTNVVDQAKQAINEAGAALKAAFAAKR

SEQ ID NO: 239 - DNA, 615 bp, Unknown
  Obtained from environmental sample
atgaaaacagcgctcctgatttacatgacgattttcctggcggccgcccaacagcccgccgccggggactcccgcccggttatcgtcgcgttcggcgacagcctgacggccggctatggcctgccgcccggcgccggttatcccgaacaactgcagcagagactggacgcgcgcggacaccgctaccgtgtcgtcaacatggggatcagcggcgacacgaccagcggcggactcgcccgaatgaaagcggcgctggaactcaagcccgccatcgtcattcttgaactcggcgccaacgatggcctgcgcggcctccccgtcgatcagatgcgcgccaatctggaggagatgatcacggcctttcgcaagagcggcgcgaccgtcgtcctcgccggcatgaccctgccgcggaactatggagccgcttatattcggtcctttgaacaggtgtttaccgatctggcgaagaaatacaatttgcctcttatcccatttttcctggacggcgtcgccggagatccgaagtttaccctgcccgacttcatccatcccaacgccgaaggttatcgcatcgtgaccgaaacggtcatgaaaaccctcgagccgctcctgtag

SEQ ID NO: 240 - protein, 204 aa, Unknown
  Obtained from environmental sample
  DOMAIN (28)...(196): GDSL-like Lipase/Acylhydrolase
MKTALLIYMTIFLAAAQQPAAGDSRPVIVAFGDSLTAGYGLPPGAGYPEQLQQRLDARGHRYRVVNMGISGDTTSGGLARMKAALELKPAIVILELGANDGLRGLPVDQMRANLEEMITAFRKSGATVVLAGMTLPRNYGAAYIRSFEQVFTDLAKKYNLPLIPFFLDGVAGDPKFTLPDFIHPNAEGYRIVTETVMKTLEPLL

SEQ ID NO: 241 - DNA, 732 bp, Unknown
  Obtained from environmental sample
atgcttgacggctggtttgacgatcacgtagtggtcaaaaatatggccgcttctggccgaagcgcgaaaagttttattgaggaagggcggctcgagcgcattttgcgggagctcaaaaaaggcgattatttgttcatccaatttggccataacgatgaaaaggtgaacgacccggcgcgccacaccgagccgttcaccacctatcaggcatatttgaaacagtatattgacggcgcccgcgccaaaggggcgactcctgtcctcatcaccccggtcgaacggcggcggttttctgccgacggacgggcgctcgattcccacggacgctatcctgccgccatgaaagcgctcggaaaacacgaacgtgtcccagtgatcgatttgacaacgaaaagcaaacaacggtttgaacagcttggaccggaacggacgaagcggtggtttttatggcttgagccgggcgaacaccccaattatccgaaaggcatcaaagacaacacccattttcatcagcgcggggcgaaagaaatcgcccgtttggtcgtcgaaggcatcgtcgaactgaatctccctcttcgccgccacccacggactgttcggtttttggatcatttgcaagtcttcgtcactcaaatcgatgccgtatactttgatttccgtacgcccggcttgctcgatggcgcgcgtcgctcctttggcgaactcgtcccaagctgcgaagacggcgtcaat

SEQ ID NO: 242 - protein, 244 aa, Unknown
  Obtained from environmental sample
  DOMAIN (3)...(181): GDSL-like Lipase/Acylhydrolase
MLDGWFDDHVVVKNMAASGRSAKSFIEEGRLERILRELKKGDYLFIQFGHNDEKVNDPARHTEPFTTYQAYLKQYIDGARAKGATPVLITPVERRRFSADGRALDSHGRYPAAMKALGKHERVPVIDLTTKSKQRFEQLGPERTKRWFLWLEPGEHPNYPKGIKDNTHFHQRGAKEIARLVVEGIVELNLPLRRHPRTVRFLDHLQVFVTQIDAVYFDFRTPGLLDGARRSFGELVPSCEDGVN

SEQ ID NO: 243 - DNA, 1260 bp, Unknown
  Obtained from environmental sample
atgcagcgcgtcatcgcttcgctgacggccgccttttcatcggccgcggctcttgcatcgctcgcactactcgcattcgccaccactgccacaccggctcacgcggccaacaccgaccccatcatcctcgtgcacggctttgcaggtttcggccgcgacgaggcgctcggctacaaatactggggcggcttcgacgatctcgaggtgtatctcacgagccagggccgcacgaccagaaccgccgtcgtcggaccggtgagttccaactgggaccgcgcggtcgaactttactatcagatcaagggcgggtgtgtggactacggcagtgcccacgccgggcatttcggtcacgatcgcacggtgccgggcaagtgctttccgggcctgtatccgcagtgggacgcggcacatccggtgcatctcgtgtcgcacagcatgggcggccagacggccaagatgctcgtgcatctcctcgaggccaacggtgcgccgcatgaaaccggattgttcggcggcgccaaacgcgggtgggtcaaaagcgtgacggcgatctcgtcgccgctcaacggcaccacgcttgccaacgtagtgggcaacgacattcccttcgtgatcgacgtggtgggcggcatcgccgcgctgaccggcgtcagcgacaaggacaacttcgtctacaacttcaagctcgagcagtgggacctgaagcgctatcccggcgagcgttttaccgactatcagaaccgcatcgtggattcgccgatctgggagcatccggtggcccgcaaggatctgagcctgtgggtgctgtcgcccgacggcgcggccgaggaaaacgcgtgggtgcagacctggtccaacgtctactacttctcgtttgcgaccaacagcacattcaccggcctcttcaccggctgggaatatccgtcggccacgacgaatccgctcacgctgccgttcgtgtatcccgccgcgtggccgctgccgcccggcgtgggcaactacaccagcaatcgcgcgggacaggtggccatcgacaaaacctggtggcccaacgacgccgtcgtgaatacgaagagcatggttgcgccgtggaacggttcaagcatcgcggtgaactggaacggggccgcacagcgcggcaaatggaattacatggggctttccaccgggttcgaccacttcgacatcatcgggtggtcgctcttctgggatgcgcggtcgttctatcttacgcacgcaaatcgtttgcgcgcgctttag

SEQ ID NO: 244 - protein, 419 aa, Unknown
  Obtained from environmental sample
  SIGNAL (1)...(35)
MQRVIASLTAAFSSAAALASLALLAFATTATPAHAANTDPIILVHGFAGFGRDEALGYKYWGGFDDLEVYLTSQGRTTRTAVVGPVSSNWDRAVELYYQIKGGCVDYGSAHAGHFGHDRTVPGKCFPGLYPQWDAAHPVHLVSHSMGGQTAKMLVHLLEANGAPHETGLFGGAKRGWVKSVTAISSPLNGTTLANVVGNDIPFVIDVVGGIAALTGVSDKDNFVYNFKLEQWDLKRYPGERFTDYQNRIVDSPIWEHPVARKDLSLWVLSPDGAAEENAWVQTWSNVYYFSFATNSTFTGLFTGWEYPSATTNPLTLPFVYPAAWPLPPGVGNYTSNRAGQVAIDKTWWPNDAVVNTKSMVAPWNGSSIAVNWNGAAQRGKWNYMGLSTGFDHFDIIGWSLFWDARSFYLTHANRLRAL

SEQ ID NO: 245 - DNA, 1506 bp, Unknown
  Obtained from environmental sample
atgcaaaatccctccgcccctgtggttgaaacgcgccagggcgcactgactggtttcacagataacaatattcatgtgtggtgtgggatcccctacgcttcaccgcccgtgggcgactggcgctggcgctctccgcgtccgccggaaagctgggagggcgaacggcaggcaacgacgttttcgccctcaagctggcaaagcattgagtactgcaaagagctgggcggcggcgatcccggccagttctcggaagattgtctctatcttaacgtctggtctcccgtcgatcgcgccggaccgcttccggtcatggtctggctgcacggcggcgggttcacgattggcgcgggtagcctgccgccatacaacggtaaagcgctggcatcgcgcggtgtggtggttgtgacgatcaactaccgtctgggtcatctcggctttttcgcgcatccggcgctggaaggtgaagaaagccgcgtggtgcataactttgcgctacttgaccagatcgccgcgctggagtgggtgcgggataacattgccgcgtttggcggggatccgaacggcgtcacgctgtttggtgaatctgcgggcgcgcgcagcgtgttgtcgctgatggcatcgccgctggcggaaggattgttccataaagcgatcgtgcaaagcgggtacaccttgccggatacgccgcgcgagaaagccttacaaaaaggggaagccatagcctcccatttcgggctggagaatgccaccgccgagcagctgcgcgcgctgccgcctgaggccttctggccgctcacgtcaccgctgaacgttgcgcctgctcccgtcgtcggggattgcgtcttgccggaagcgatgctggatgtgttctttgccgcgcgtcagcatcccgttccgctaatgataggttcgaatagcgatgaagccagcgtgatggcggtgtttggcgtggatctggccgggcaaattcagaagcttcgccgggaacgacgctttggactggggctgattaagctgctctatccgggcgtgaagggggatgaagagctgggcagactggtgtgccgtgatatggcctttaccacgatgggctatgtggcgatgcaggctcagcagcgtgtcggcggactgtgctggcgctactggtttgattatgtcgcggaagcggaacatgccacctacatcaacggtgcctggcacggcaatgaagtgccttacgtattcgataccctgggccaggtggaaccttctcgtcagtacgtgaacgaacgcgatctgcagtttgctgcccaggtcgctgattactgggtgagcttcgcgcgtgatgccggggcgcaggacagcttatccggcccggtgcactggccagcctgtcgcaaaggacgcgacgtgctgttacgcattggtgtgaataaacatgcaggtttcaggcttgaaaaccgctttatgcgcgcccgcatgagtctcttcaaacgggtgatgaagcaccacgtcagcctcgattaa

SEQ ID NO: 246 - protein, 501 aa, Unknown
  Obtained from environmental sample
  DOMAIN (1)...(486): Carboxylesterase
MQNPSAPVVETRQGALTGFTDNNIHVWCGIPYASPPVGDWRWRSPRPPESWEGERQATTFSPSSWQSIEYCKELGGGDPGQFSEDCLYLNVWSPVDRAGPLPVMVWLHGGGFTIGAGSLPPYNGKALASRGVVVVTINYRLGHLGFFAHPALEGEESRVVHNFALLDQIAALEWVRDNIAAFGGDPNGVTLFGESAGARSVLSLMASPLAEGLFHKAIVQSGYTLPDTPREKALQKGEAIASHFGLENATAEQLRALPPEAFWPLTSPLNVAPAPVVGDCVLPEAMLDVFFAARQHPVPLMIGSNSDEASVMAVFGVDLAGQIQKLRRERRFGLGLIKLLYPGVKGDEELGRLVCRDMAFTTMGYVAMQAQQRVGGLCWRYWFDYVAEAEHATYINGAWHGNEVPYVFDTLGQVEPSRQYVNERDLQFAAQVADYWVSFARDAGAQDSLSGPVHWPACRKGRDVLLRIGVNKHAGFRLENRFMRARMSLFKRVMKHHVSLD

SEQ ID NO: 247 - DNA, 1695 bp, Unknown
  Obtained from environmental sample
atgagacgactggtgcttggaggagtggtcgggacgatcctcgccgttacgccgggcctgcgcgcggccttaccggacccggtgagcctcgatacagggcaggtgtccgggatcgcaacctcgacgcctgacgtgcgggccttcaagggcatccccttcgcggcgccgccggtgggtgagaaccggtggcgcgcgccgcagccggcgccgaagtgggagggcatccgcaaggccgatgcgttcgggtcgaactgtctggccggcgctcccggcggcggccgcggcggccgcggtggtcgtggcgccgccgccgctcccggcgcagcgccggcgcctcccgccgcacccggggtacctggcgcccgcggcgcggcggcccaggccccggcggcaccagccgccccgggggggcgcggcgccgcgcccggcggaggggcaccaccaccggcggccagcgaagactgtctccatgtcaacgtgtggacggcggcggagcgcaacaccgagcggcgtccggtcatgatgtggatttacggcggggggttcaccggcggctccagctcgcagggctggtacgacggcgaacagctcgcggccaagggcgccgtcgtcgtgacgttcaactatcgcctcggggccttcgggttcttcgcgcatcccgaactggcgaaggagtcggggcggaacgcgtcgggcaactacgggatgatggacgccatcgcggcgctccagtggattcagcgcaacatcacggccttcggcggcgacccgaccaacgtcaccgtgttcggcgagtcggccggcgccatcatgacggccgcgctcgtcggctcaccacaggcgaagggcctcttccatcgcgccatcctgcagagtggcggctggatggggttgcagatgaaccgcatgacgagcggtgagcaggcgcagggcaacggcgtcaaggccatgcaggcgctcgaggccccgtccgtcgccgagttgcgtgcgcggccgctggcggacctggcggggctcagcggcagcggtctcgtcatcgatggttacctcgtgccggaagacctgtcgatcaccttcgcgcaggggcggcagaacgaggtggacatcatcgccggctcgaacaaggacgaagcgacgttcttcggcggcggcacgcgcacggcgcaggtgcatcaggatcaggcgggccagcggttcggtgagctggcgccggagtacatgaagttctatccggcggcgagcgacacgcaggcagtcacgtcctacaacgacgcctacgcgcacgagaccaactggcacatgcggcttgccgcgcaggcgcaggcgcgcaaggggaaggacgcctacgtctactacttcacgcgcgttccgctcggcgccgacggccagccctcgccccgcggcgccacgcacacggccgagatccgctacgccttcaacacccgcgacggccaggtgtgggacgatgtcgatcgcaggctcgccgacacgatgtcgtcgtactgggtgaacttcgcgcgcacggggaacccgaacggacaggggttgccgaactggcccgcgttccgcgacatgcagagcggccgcgccatcgtgctcggcgacaccgtgcaggtggagtcgtcgccattcacgccgcagctcgggttcttcgatcgcgcgtatcagcggctgatgcggcagatccagggttga

SEQ ID NO: 248 - protein, 564 aa, Unknown
  Obtained from environmental sample
  SIGNAL (1)...(22)
  DOMAIN (12)...(551): Carboxylesterase
MRRLVLGGVVGTILAVTPGLRAALPDPVSLDTGQVSGIATSTPDVRAFKGIPFAAPPVGENRWRAPQPAPKWEGIRKADAFGSNCLAGAPGGGRGGRGGRGAAAAPGAAPAPPAAPGVPGARGAAAQAPAAPAAPGGRGAAPGGGAPPPAASEDCLHVNVWTAAERNTERRPVMMWIYGGGFTGGSSSQGWYDGEQLAAKGAVVVTFNYRLGAFGFFAHPELAKESGRNASGNYGMMDAIAALQWIQRNITAFGGDPTNVTVFGESAGAIMTAALVGSPQAKGLFHRAILQSGGWMGLQMNRMTSGEQAQGNGVKAMQALEAPSVAELRARPLADLAGLSGSGLVIDGYLVPEDLSITFAQGRQNEVDIIAGSNKDEATFFGGGTRTAQVHQDQAGQRFGELAPEYMKFYPAASDTQAVTSYNDAYAHETNWHMRLAAQAQARKGKDAYVYYFTRVPLGADGQPSPRGATHTAEIRYAFNTRDGQVWDDVDRRLADTMSSYWVNFARTGNPNGQGLPNWPAFRDMQSGRAIVLGDTVQVESSPFTPQLGFFDRAYQRLMRQIQG

SEQ ID NO: 249 - DNA, 705 bp, Unknown
  Obtained from environmental sample
atgagccagaccttacatttacaatttacccgactagccgacttggattgtttggcattacctcttcaggcggaccgcccaaccatcgtgatgttgcatggttatggcgctaattttgaggatcttgccggtctcgttccgatgcttgatccaaagggccaatggaactggatctttccgaatggcattttggaagtaccgatagaccaacatgtgatgggacgtgcctggtttccaatcgacatggaggccttgcaacggcatttgatggggggtgaagtacgcagcttcgcccatcatattcccgcagggctcgaaactgcccaaaagcggatcggtgaattgatttcggctttgggtatcaaagccgaagatttggtacttgcaggctttagtcagggcgcgatggtgacgtgccatacaatgatggctatgaaggaaaaccccagggcactgattcagctttcatccacattggtttccgaagaaacctgccgggaaaacatgccccggcaccaagatcttaaaatcttccaaagccacggccaattcgatccgttattgccgattgcggcagccagagaactcaagcaggtgtttgaagcctcatccagccatgtcgattaccacgagtttgccggggctcacgagattcctctgccgattatccaaaagcttgggagctttatgcaaagcgtgctctaa

SEQ ID NO: 250 - protein, 234 aa, Unknown
  Obtained from environmental sample
  DOMAIN (15)...(234): Phospholipase/Carboxylesterase
MSQTLHLQFTRLADLDCLALPLQADRPTIVMLHGYGANFEDLAGLVPMLDPKGQWNWIFPNGILEVPIDQHVMGRAWFPIDMEALQRHLMGGEVRSFAHHIPAGLETAQKRIGELISALGIKAEDLVLAGFSQGAMVTCHTMMAMKENPRALIQLSSTLVSEETCRENMPRHQDLKIFQSHGQFDPLLPIAAARELKQVFEASSSHVDYHEFAGAHEIPLPIIQKLGSFMQSVL

SEQ ID NO: 251 - DNA, 1215 bp, Unknown
  Obtained from environmental sample
atgaagtacattgtcattctaaagaaaggttacaatagagattcacttacagactactgcacaaaagtaggtaagccatgtgagctacacaatctcgttatcattaacactgacgaagctacagcaaaaattgttgctgatttagattgtgtagaatctattgagaaagattctgtatgtacatctgatgaggaattttacaagtcatctcgtactactgataattgggcattgacacgattcaattttacagaacctcaacgagagtatcctgagagttaccgttacaatcgcacaggaaaaggtgtgggcatctacgttattgacagtggtgtccgtactactcatcaagagttagtaggacgtgtagagactgtctacagtgttctcgaaggtaagcaatttgacagtgataatgagctaaacattaaccgtagccatggcacagcagtggcgtcagcagcagcagggaagaagctaggtattgcaagtgaagctactgtctacaacttattcgtagatttttctatgtcagacattatcaaagcgtttgatactgtattgcaccattacaaaaagtctaagagtgctgctgtacttgtgacatcattctcaactttgtcactagcaatgaaacctatctcagacgcactctaccaagcaggtctcgttcatgtatctagtgcaggcaatcagtctacagatactccaagataccctgctgcattccctcagactatctctgtaggtgctactgacaagcaggacaataaagcatcattcagtaactttggcaataccgtagacgtatatgcacccggagtgaatgtgaaggtagcggatcatgcaagagatgttcgtactcgtattgcaagagggacttctttctctgcaccttatgttgctggtatcattgcactcatgctagaagattcagacaagcctcgtaagcgcgagcatgtcgataccatacgacaatccttcctagacaatgctacaagtatttccaaggcagataagcgtgtgccacatacacgttttgacattgaaccgttcaagtttcctaaaccttctcctgtagaaaaaattgtacaaaaggtgtctgacaataaggatacgtcaagtatttcagacaaaaaacgtaaaaagagttacacgaaacagattgtagcaggcgttatcctagcagctactatagttgcaattcttgtgtaa

SEQ ID NO: 252 - protein, 404 aa, Unknown
  Obtained from environmental sample
  DOMAIN (85)...(345): Subtilase family
MKYIVILKKGYNRDSLTDYCTKVGKPCELHNLVIINTDEATAKIVADLDCVESIEKDSVCTSDEEFYKSSRTTDNWALTRFNFTEPQREYPESYRYNRTGKGVGIYVIDSGVRTTHQELVGRVETVYSVLEGKQFDSDNELNINRSHGTAVASAAAGKKLGIASEATVYNLFVDFSMSDIIKAFDTVLHHYKKSKSAAVLVTSFSTLSLAMKPISDALYQAGLVHVSSAGNQSTDTPRYPAAFPQTISVGATDKQDNKASFSNFGNTVDVYAPGVNVKVADHARDVRTRIARGTSFSAPYVAGIIALMLEDSDKPRKREHVDTIRQSFLDNATSISKADKRVPHTRFDIEPFKFPKPSPVEKIVQKVSDNKDTSSISDKKRKKSYTKQIVAGVILAATIVAILV

SEQ ID NO: 253 - DNA, 927 bp, Unknown
  Obtained from environmental sample
atgccgagcccaaaaagtaatattgatgttatcagcatcgatggtggtggaatacgtggagtattctccgttacattattggatagattatgtaagacctatcccaatcttcttaagaaaacatatctgtttgctggaacatctacaggtgggatcattgccttaggattagcaaacaacatgacacctcttgagataagagccttgtacgagaagaacggttcaaagatatttcataaatctgtgtgggaaggcgttaaagatttaggtggaaccataggtgcaaagtatagtaacaagaatcttaaatccgttttgaaaaaatactttggttcattgaagttaaaagatttatctaaaaaagtactaatacctacttttgatttacactcagacaaagaagaaggctatccaatgtggaagcctaagttctatcacaactttgatggagaaacggaagatatagaaaagctcgttcttgatgtagctatgatgacatcagcagcgcccactttcttccctacatacaacgggcatattgatggcggtgttgtagccaacaatccatcgatggccgcattagcccagattatggatgaaagatatggcatcaatgcctctgaagttcatattcttaatataggaacaggttttaaccctgcttatgttaagatgaatccaggggaagagaaagactggggtgaacttcagtggataaaacctttaatcaatcttctagtcgatggctctatggatgtttctacttattattgtaagcaagtcttacgtgataatttttatagggttaacatgaaattacctaagaacgtagaaatggatgatcctaattctattccttatttaattgaacttgcaaactcagttgatctaactgaatgtatcaactggcttaattcgaggtggtaa

SEQ ID NO: 254 - protein, 308 aa, Unknown
  Obtained from environmental sample
  DOMAIN (11)...(194): Patatin-like phospholipase
MPSPKSNIDVISIDGGGIRGVFSVTLLDRLCKTYPNLLKKTYLFAGTSTGGIIALGLANNMTPLEIRALYEKNGSKIFHKSVWEGVKDLGGTIGAKYSNKNLKSVLKKYFGSLKLKDLSKKVLIPTFDLHSDKEEGYPMWKPKFYHNFDGETEDIEKLVLDVAMMTSAAPTFFPTYNGHIDGGVVANNPSMAALAQIMDERYGINASEVHILNIGTGFNPAYVKMNPGEEKDWGELQWIKPLINLLVDGSMDVSTYYCKQVLRDNFYRVNMKLPKNVEMDDPNSIPYLIELANSVDLTECINWLNSRW

SEQ ID NO: 255 - DNA, 933 bp, Unknown
  Obtained from environmental sample
atgaagaattgggcgattgccggagccgcggttgccgcgggattgcttggcggcgggctgttcacgcgccgggcgacagcgcgggccgaggcgatggtgccaatggacggccgtctgatcgaggccgggccctaccggatccacgtcgcggaacagggaaacgggcggcccttgctcctgatccacgggctcagcgcgcagctgcgaagctttgcgcaggtgatggtggacgagcttgccaaggaccaccgcgtcatccgcatcgatcggccgggttcgggctactccccgcccctaccctcgggctcgcagcaccttgccgaccaggccgatgcaatcgctgcgctgatcgacgcactcgaactcgaccgtccgatactggtcggccattcacttggcggagcgctgtcgctccacatcgcgcagcggtatccggacaaggtgggcgggctggcgctgatcgccccggcgacccagccggtgaccgatgttcccccggtattccgtgggctgatgatcccgcccgctttgatcccgctcgtcgcgcgaacgatcgcggtgccaatgggtgtcgcgacccgcgaccgggtgcttgccgaagtgttcaagcccgagcccgttcccgccgactaccttatcgccggcggcggcgcgcttgcgcttcgtgcgggcaatgtcgaagcggccgccggcgatctccggctggcgcggaccgatgccgaggagatggtcggccgctacggcgacctgaaggtgccgaccgccatcctctacggccgctcggacaatctgctcgactatcgcattcacggcgaaaagaccgcggcggagatccccggcgcgcgcctgaccctggtcgaaggcggccacatgctgcccttcacccagccactcgaaaccgccttgtgggtacgcagcgtccttcccgcttag

SEQ ID NO: 256 - protein, 310 aa, Unknown
  Obtained from environmental sample
  SIGNAL (1)...(27)
  DOMAIN (83)...(306): alpha/beta hydrolase fold
MKNWAIAGAAVAAGLLGGGLFTRRATARAEAMVPMDGRLIEAGPYRIHVAEQGNGRPLLLIHGLSAQLRSFAQVMVDELAKDHRVIRIDRPGSGYSPPLPSGSQHLADQADAIAALIDALELDRPILVGHSLGGALSLHIAQRYPDKVGGLALIAPATQPVTDVPPVFRGLMIPPALIPLVARTIAVPMGVATRDRVLAEVFKPEPVPADYLIAGGGALALRAGNVEAAAGDLRLARTDAEEMVGRYGDLKVPTAILYGRSDNLLDYRIHGEKTAAEIPGARLTLVEGGHMLPFTQPLETALWVRSVLPA

SEQ ID NO: 257 - DNA, 1152 bp, Unknown
  Obtained from environmental sample
atgagttgggtcatcggtctgatcatcgtcctcgtgctgctctgggccattgcccgattccatctcgcgggcgagaacctttcgcggttcgatggcgcgacggacgcgattcgagtcgcttcgtccagggagccgagcccggagcatcaccaggccgtcgagaccatccgggccatgcagcgcgaggccagcggcgggctgagcccgcgagaacgcctgcgggtgatgcgcacgcgcttcgacgccctcggtgaaggcgacttcggcgccaccttctcagccgtcgaggccgggggtgtgccggcggagtgggttctcgcggcgggcgcggatcctgaccgccgtctgctctatcttcacggtggcgcctacatgctcggcagcccgaagagccaccgcgccatcacgtcgaagttctccaggatcgccggcgccgcggtgttggccgtcgactatcgcctgatgcccgagcatcgccgcatcgccggcatcgaggactgccgcagcgcctatgagtggatcctcgagcacgggccggatgggcccgcaccggtgcaggccctgttcgtggccggcgattccgccggcggtaacctcgctctcgccacaatcgcctgggcgcgcgatgccggactgcgcgcggccgacgccgtggtggtgctgtcgccccacactgatggctgcatggccagtccgagcctgaagagcaacatgaagaccgatcacatgctcggtccgatgttcgcccgcatggcccatgtgccgcgctctctgagcctctggatggcgtggctgaccggccggatgccaccggctgatccacgggtctcgccgctgcgcggtgagcttcgagacctgccgccgacgctggtccacgcgagcgaagcggagatgctcctcgacgacgcgcggcgctacgtcaacaaggcccgggccgcgggcaccgacgcccgcctgcatacctggccgcatcagctgcacgtctggcacatcttcgagcagacgttgcctgaagcccgcgaggcgtttgccgacatcgaggcattcctggcggagtgggcgccacaggatgtcgagagtgcggacctgccgagcagggtctcggcgagtgcggcacacccggaaccccggcgcgctcgcagcgtcgaatag

SEQ ID NO: 258 - protein, 383 aa, Unknown
  Obtained from environmental sample
MSWVIGLIIVLVLLWAIARFHLAGENLSRFDGATDAIRVASSREPSPEHHQAVETIRAMQREASGGLSPRERLRVMRTRFDALGEGDFGATFSAVEAGGVPAEWVLAAGADPDRRLLYLHGGAYMLGSPKSHRAITSKFSRIAGAAVLAVDYRLMPEHRRIAGIEDCRSAYEWILEHGPDGPAPVQALFVAGDSAGGNLALATIAWARDAGLRAADAVVVLSPHTDGCMASPSLKSNMKTDHMLGPMFARMAHVPRSLSLWMAWLTGRMPPADPRVSPLRGELRDLPPTLVHASEAEMLLDDARRYVNKARAAGTDARLHTWPHQLHVWHIFEQTLPEAREAFADIEAFLAEWAPQDVESADLPSRVSASAAHPEPRRARSVE

SEQ ID NO: 259 - DNA, 930 bp, Unknown
  Obtained from environmental sample
atgaggaattgggcaatcggcgggctggcgctgggcgcgggtgcgctgggagcgggcctgtacaccagccgcaaggcacgggaggccgaggccgcggtgccgatggacgggcgcatggtagaggccggcgggcaccgcttccatgtcgcggagcaggggcagggccggccgctgctgctgatccatgggctcgccgggcagatgcgcaacttcgggcagccgatgctcgacgacctggcgcgcgactatcgggtcatccggatcgaccggccggggtccggctactcgccgcggctggcgagcgggcgcgggcatctgtcgggacaggccgacgccatcgccgcgctgatcgacgcgcttggcctggagaaaccggtgctggtggggcattcgctgggtggtgcggtgagcctcgcgacggccatgcgccatcccgacaaggtcggcgcgctggcactgatcgctccggcgacccagccgatccagagcattcccgaggtgttcaagggactggtcgtcccgcccgctttgctgcccctggtcgcctggaccatcgccgttcccgtgggcgtcgcgaccaaggacaaggtgctgcagcaggtgttcgcgcccgagccggtgccggcgaactttctggtggatggcggcggcatgctcgggttccggcccaagaacttcgagggcgcggcaaccgacctcgccgacgccagcagcgaggccgagaccctgctgccgggctacgccgggctgaagctgccggtcggcatcttctacgggcgcggggacaatctgctcgactatcgactgcatggcgagaagaccgcatccgagatcccgggcgcccggctgacgctgaccgagggcggccacatgctgcccttcacccaaccggaggcgaccgcccgcttcgtccggagcgtgatcgagtaa

SEQ ID NO: 260 - protein, 309 aa, Unknown
  Obtained from environmental sample
  DOMAIN (83)...(306): alpha/beta hydrolase fold
MRNWAIGGLALGAGALGAGLYTSRKAREAEAAVPMDGRMVEAGGHRFHVAEQGQGRPLLLIHGLAGQMRNFGQPMLDDLARDYRVIRIDRPGSGYSPRLASGRGHLSGQADAIAALIDALGLEKPVLVGHSLGGAVSLATAMRHPDKVGALALIAPATQPIQSIPEVFKGLVVPPALLPLVAWTIAVPVGVATKDKVLQQVFAPEPVPANFLVDGGGMLGFRPKNFEGAATDLADASSEAETLLPGYAGLKLPVGIFYGRGDNLLDYRLHGEKTASEIPGARLTLTEGGHMLPFTQPEATARFVRSVIE

SEQ ID NO: 261 - DNA, 1854 bp, Unknown
  Obtained from environmental sample
atgggtgtgtatgactacaagaacttcagcacagcggattccaaggccttattcagcgatgccatggccatcacgctgtactcctatcacaacctcgacaacggtttcgcggtcggctatcagcacaacggtttcggcctcggtctgccggctacgttgatcagtgcgctgatcggcggcaccgattctcaaggggtgattcccggactgccgtggaatcccgactcggaaaaactcgccctcgatgccgtgaagaaggccggatggacaccgatcaccgcctcgcaactcggctatgacggcaagaccgacgtgcgcggaaccttcttcggcgaaaagcccggctacaccagcgcccaggtggaaatcctcggcaagtacgacgcccagggccatctcacggaaatcggcatcgcctttcgcggcaccagcggcccacgggaaatcctcatcggcgactccatcgccgacgccatcaatgacctgctcgccgcgttcgggcccaaggattacgccaagaactacgtcggcgaagccttcggcaacctgatgaacaacgtggtggccttcgccaaggccaacggcctcaccggcaaggacgtgctggtcagcggccacagcctcggcggcctggcggtcaacagcatggcggacctgagcggcagcaaatggggcgggttctttcaggactccaactacatcgcctatgcctcgccgacccagagcagcaccgacaaggtgctcaacgtcggctacgagaacgacccggtgttccgcgccctcgacggctcgaccttcaccggggcatcgctgggtgtccacgacgcatcgaaagtctcggcgaccgacaacatcgtcagcttcaacgaccactacgcctcgaatgcgtggaacgtgctgccgtattcgatcgtcaacattccgacctggatctcgcacctgccgacggcttacggcgacggcatgaaccgggtcatcgagtcgaagttctacgacctcaccagccgtgactcgacgatcatcgtcgccaatctgtcggacccggcgcgggccaacacctgggtgcaggacctcaaccgcaacgccgagccccacaagggcagcaccttcatcatcggcagcgacggcaacgatctgatccagggtggcagcggcaacgattatctggaaggccgtgccggcaacgacaccttccgcgacagcggcggctacaacatcatcctcggcggttcaggcaacaacaccctcgagttgcagcagtcggtgaacaagttcgacttcgccaacgacggcgccggcaacctgtacatccgcgatgccaacggtggaatcagcatcacccgcgacatcggcagcatcgtcaccaaggagccgggtttcctctggggcctgttcaaggacgacgtgacccacagcgtcaaagccgatggcctgaaggtcggcaataacgtcacccagtacgaatcgagcgtgaagggcactagtggcgccgacaccctcaaggcccacgccggcggtgactggctgttcggcctggacggcaacgatcacctgatcggtggcgcgggcaacgacgtgttcgtcggcggcgccggcaatgacctgatggagtcgggcggcggggcggatacgttcctgttcagcggcgcattcggccaggaccgggtggtgggcttcaacggcaacgacaaactggtgttcctcggcgtgcagggcgtgttgcccggcgatgacttccgcgcccatgcctcgtcggtggggcaggatacggtgctcaagtttggcgctgattcggtgacgctggtcggggtttcgctgaacagtctcagcgccgatggcatcgtgatcgcctga

SEQ ID NO: 262 - protein, 617 aa, Unknown
  Obtained from environmental sample
  DOMAIN (133)...(265): Lipase (class 3)
  DOMAIN (381)...(398): Hemolysin-type calcium-binding repeat (2 copies)
  DOMAIN (510)...(527): Hemolysin-type calcium-binding repeat (2 copies)
MGVYDYKNFSTADSKALFSDAMAITLYSYHNLDNGFAVGYQHNGFGLGLPATLISALIGGTDSQGVIPGLPWNPDSEKLALDAVKKAGWTPITASQLGYDGKTDVRGTFFGEKPGYTSAQVEILGKYDAQGHLTEIGIAFRGTSGPREILIGDSIADAINDLLAAFGPKDYAKNYVGEAFGNLMNNVVAFAKANGLTGKDVLVSGHSLGGLAVNSMADLSGSKWGGFFQDSNYIAYASPTQSSTDKVLNVGYENDPVFRALDGSTFTGASLGVHDASKVSATDNIVSFNDHYASNAWNVLPYSIVNIPTWISHLPTAYGDGMNRVIESKFYDLTSRDSTIIVANLSDPARANTWVQDLNRNAEPHKGSTFIIGSDGNDLIQGGSGNDYLEGRAGNDTFRDSGGYNIILGGSGNNTLELQQSVNKFDFANDGAGNLYIRDANGGISITRDIGSIVTKEPGFLWGLFKDDVTHSVKADGLKVGNNVTQYESSVKGTSGADTLKAHAGGDWLFGLDGNDHLIGGAGNDVFVGGAGNDLMESGGGADTFLFSGAFGQDRVVGFNGNDKLVFLGVQGVLPGDDFRAHASSVGQDTVLKFGADSVTLVGVSLNSLSADGIVIA

SEQ ID NO: 263 - DNA, 1092 bp, Unknown
  Obtained from environmental sample
ttgatcctccccacccacctcgccttcgcttccgtcctgtacctgggcggggcggcgctgttcggctaccggcccgacgcggtcggctgggcgctggcgaccgtcgcctgcctgctgccggacgtggatttaccgaccgccaagatcgggcggctgtgctggttcgtggccgtgcccctggagcggcgcttcggacatcggaccgtgactcattccgccgtgggcctgctggccgtggccgggttggccctgccgctgtggtggatcgagccgctgtacttctgggcggtggtcggggggtactggtcgcacctgtggctggacatgctcaacctgcgcggggtggatctgttctggcccagtcccattcgggtggtgacgccgggcaatcgccagtggcggttccaggtgggcggcaagggggaaatgatcctcttggccgggctgctggtggttacggtggcgctgtatccgttgagccacctggggttccgggacgggttgcaggcggtgctgaagaacttcgacatcgcgcgggaacagtaccagcgccaggccgggacccactggtatcggctggacttggacgccaccgatcatctgaccctgcaagcggtgcggggggagttcccgatcgtgggggtgtggcagaacggcttgatcgtggaacgggacgggcagttgcgggcggtgggcgcgaatccggcccggcacaacctgtatccgctgaaagcccggctgctccagggcgagccgctgcgagtgatgaccgagcgggtggcgatgcaaggccggaccctgcgttggctggtcgggcgcatcgatccaactcgcccgtattacctgctgggcgaggtggagatggccgacgcccgcgcccaggcccgcatcgccctcctgacggacatcgagacttacaacccggccagctatcggggcggcatcctcaccctgcactacgcccgcgcccaggagctcgaaccgtggctggacctggtggcggtccggggcgaggtgatcgtgcagttctggctccggcccggcgaggcggcggtgaccctggggccgggggcggaacggcactgccattaa

SEQ ID NO: 264 - protein, 363 aa, Unknown
  Obtained from environmental sample
  DOMAIN (35)...(124): Predicted membrane-bound metal-dependent hydrolase (DUF457)
MILPTHLAFASVLYLGGAALFGYRPDAVGWALATVACLLPDVDLPTAKIGRLCWFVAVPLERRFGHRTVTHSAVGLLAVAGLALPLWWIEPLYFWAVVGGYWSHLWLDMLNLRGVDLFWPSPIRVVTPGNRQWRFQVGGKGEMILLAGLLVVTVALYPLSHLGFRDGLQAVLKNFDIAREQYQRQAGTHWYRLDLDATDHLTLQAVRGEFPIVGVWQNGLIVERDGQLRAVGANPARHNLYPLKARLLQGEPLRVMTERVAMQGRTLRWLVGRIDPTRPYYLLGEVEMADARAQARIALLTDIETYNPASYRGGILTLHYARAQELEPWLDLVAVRGEVIVQFWLRPGEAAVTLGPGAERHCH

SEQ ID NO: 265 - DNA, 1632 bp, Unknown
  Obtained from environmental sample
atgaaagaacaagccattcatccgatcatttacgtgcgcggctacgcgatgactcaaaacgaaatcgaggacacggtggccgacccgtatatgggtttcaatatcggctcgtgcaagatccgccaggtctgggatgggtcggtgaagaaatatttctttgaatcaccactcgtgcgcttgatgaaggagttcgattacgacgacgtgtatgaacaaggcatcgacgccgtgggcgatgcccgttccctcgccgccgatagcggccccgtcggctaccggagtatcgtcatttatcgctactacgaaccctcctcggatgacctcggcacaggtcaaaagcccgatatgaagcgctttgcgactggcctgggcgaactcatcctgctgttgcgtgaccggctgtatcccaacggcgccgccacggtcatctccgcagccgagaaagcaaaggggaaattaccctacaacaaattccgcgttcatctcgtggcccattcgatgggaggactggtttgtcgcgcttttctccaaaatcccgcgttcggcactgctgaatcccgaggactcgtggacaaggtgttcacctatgcgacgccacacaacggcatcgaagttggcgtcgtcggcaacgtgccaagttggttatcgctttacggcatgaacaccttcaatcgggacgaaatagcgactctcttgaccctgaaaaaagccgatcgcgatggtgataatgtggatatcgtcaccaattttgatcccacccggattttcaatctggtgggcacaaatcccgccgattacaaaaccgcggccgggctatcgagccttgccgttggtgacgccagcgacggattggtgcgaattaaaaatgccacgacgcgcgggcgcgacgggaagacattcatccagtcgccccaggcgttcgtgcatcgcagtcactccggctacttcggcatcgtcaacagtgaggaaggttaccaaaacctgatccgctttctgttcggggacgtccgggcagacggttatctggacattgacgaacttacgttgccgccagcggtgcaaaaggaatacgacgccggcaaagaggtgcgcgcgtcctatttgtttgaggtgacggtgagcattcgcggaaaactgtggcaattgcatcgccgcacagtgaacgagaacagcgccatctttcgcaaattcgatgaattatttcccaaatggaacgcccaaaagaaagtgtgggtgccagatccatcggccagcccgatgttgttcaacgtctttctcgaccaggcgcaaagccaaaataagaagaccctggcattcgccgtagatctatgcgtgcgcgtaccgcagtacgaagtagatggctttctctttttcaaaaatcattttgaaggcgggtacctgtttcgcgacatggtggcgctggaagccacgccaccggctacgaaaaaagatgcctggaaggtcgaatacacttttgccagcaagcaaggtcaacctcctggactcgccaaggtagtggctcatgaagatcacacgctgactttcgagattccgatcgagcagcctaatccgccagggatcacggcccgcttgcgagtcgagacacgcttctggaacgattggaacacgtag

SEQ ID NO: 266 - protein, 543 aa, Unknown
  Obtained from environmental sample
MKEQAIHPIIYVRGYAMTQNEIEDTVADPYMGFNIGSCKIRQVWDGSVKKYFFESPLVRLMKEFDYDDVYEQGIDAVGDARSLAADSGPVGYRSIVIYRYYEPSSDDLGTGQKPDMKRFATGLGELILLLRDRLYPNGAATVISAAEKAKGKLPYNKFRVHLVAHSMGGLVCRAFLQNPAFGTAESRGLVDKVFTYATPHNGIEVGVVGNVPSWLSLYGMNTFNRDEIATLLTLKKADRDGDNVDIVTNFDPTRIFNLVGTNPADYKTAAGLSSLAVGDASDGLVRIKNATTRGRDGKTFIQSPQAFVHRSHSGYFGIVNSEEGYQNLIRFLFGDVRADGYLDIDELTLPPAVQKEYDAGKEVRASYLFEVTVSIRGKLWQLHRRTVNENSAIFRKFDELFPKWNAQKKVWVPDPSASPMLFNVFLDQAQSQNKKTLAFAVDLCVRVPQYEVDGFLFFKNHFEGGYLFRDMVALEATPPATKKDAWKVEYTFASKQGQPPGLAKVVAHEDHTLTFEIPIEQPNPPGITARLRVETRFWNDWNT

SEQ ID NO: 267 - DNA, 807 bp, Unknown
  Obtained from environmental sample
atgcttgtctcgctcctagagaacggaagccaagaagagcgggagtacgccaaggcgcacaacgtgtcgttgtcaccgttgtttgaaggtggacatcattttgtgttgagtgtgacgaccatcgccactcctcatgacgggacgacgcttgtcaacatggtcgatttcaccgatcgcttttttgacttgcaaaaagcggtgttggaagcggcggctgtcgccagcaacgtgccgtacacgagtcaagtatacgattttaagcttgaccaatggggactgcgccgccagccgggtgaatcgttcgaccattattttgaacggctcaagcgctcccctgtttggacgtccacagataccgcccgctacgatttatccgtttccggagctgagaagttgaatcaatgggtgcaagcaagcccgaatacgtattatttgagctttgccacagaacggacgtatcgcggagcgctcacaggcaactattatcccgaactcggaatgaatgcattcagcgcggtcgtatgcgctccgtttctcggttcgtaccgcaatccgacgctcggcattgacgaccgctggcttgaaaacgatggcattgtcaatacggtttccatgaacggtccaaagcgtggatcaagcgatcggatcgtaccgtatgatggggcgttgaaaaaaggggtttggaatgacatgggaacgtacaatgtcgaccatttggaaatcatcggcgttgacccgaatccgtcatttgatattcgcgccttttatttgcgacttgccgagcagttggcgagcttgcggccttaa

SEQ ID NO: 268 - protein, 268 aa, Unknown
  Obtained from environmental sample
MLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLRP

SEQ ID NO: 269 - DNA, 1689 bp, Unknown
  Obtained from environmental sample
atgggattgtttgactacaaaaaagccgacggcaaagcgttgtacagcgatgccatcgcgctgacgctgtattcctacacgccgaccgggcagcctttgcccggcaccggttgggcgccactgggcgcctcggccctgggttatcaaggcaagaccgacgcgaaagggacgttcttcggcgagaaggacggtttcaccagcgccgaggcggaagtgctcggcaagtacgacgccgccggcaagctgatcggtatcggcgtggcctttcgcggcacgggcgggctgagttacagcgacaccttcggcgacatgaagaacaatctgctggccgccatcgggccggtggattacgccaaaaactacgcgaagaacgccttcgacaacctgctcaaatccgtggccgcgtttgccacggcccatggcatcgcggccaaggacgtgctgatcagcggccacagcctcggcgggcttggggtcaacagcgtggcggaactgagcgcgagcgactggggcggattcttcaaggacgccaactacatttccttcgcctcgccgacccagagcagcaccggcaccaacgtgttgaatatcggcttcgagaatgacccggtgttccgtgtgctcgacggcaccacgttcagcacggcgtcgatgggcaaacacgacaagccgcacgactcgaccaccgataacatcgtcaacttcaacgacaactacgcgtccactgcgcagaacctggtgccgttcagcatcgtcaacccgctgaactggtcggcccacagttcgctgggctatgccgatggcctgaaccgggtgatcgactcgaagttctacaacctcaccagccaggactcgaccatcatcgtgtccaacctggaagcctcgtcccggggcaagacctgggtcgaggatctgggccgcagcggcgagccgcacaccggtagcaccttcatcatcggcaccgacagcaacgactggctcaagggcggggcgggcaacgacttcctcgaaggccgtgccggcgatgatctgttccgcgatgacgggggcttcaacattctgttgggtggtcagggtcacaacaccttcgacctgcagaagccattgcagaacttcagcttcgccaacgacggcgacggcacgctgtacgtgcgcgacgcctacggcggcatcagcatgacccgcgacatcggcgcaatcgtcagcaaagagtccggttcaatgtggagcagcaaggaaatcacctggaccgtcaccggcaaaggcctggccaacggcgccgaactgacccagtacaaccattcgctcaacggcggcgcactcggcgatacgctgaaagccaccgcggacggcgactggctgtttggcctgggtggcgacgatcacctggtcagcgacaaggcccatgtgactttcgtcggcggcaccggcaacgatgtcatgaatgcggtgggtggcaacaacaccttccttttcagcggcgcgttcggcttcgactcgatccatggctaccagggcagcgacaaactggtgttcatgggtgtgcagggcgcggggcagggctacgactacaagcaacatgcttcgcagtccggcgccgataccgtgctgaagattggcgactatgccgtgaccctgatcggggtgggtgtggctaacctgtcggactcgagtttcgtgttcgcttga

SEQ ID NO: 270 - protein, 562 aa, Unknown
  Obtained from environmental sample
  DOMAIN (82)...(212): Lipase (class 3)
  DOMAIN (328)...(345): Hemolysin-type calcium-binding repeat (2 copies)
MGLFDYKKADGKALYSDAIALTLYSYTPTGQPLPGTGWAPLGASALGYQGKTDAKGTFFGEKDGFTSAEAEVLGKYDAAGKLIGIGVAFRGTGGLSYSDTFGDMKNNLLAAIGPVDYAKNYAKNAFDNLLKSVAAFATAHGIAAKDVLISGHSLGGLGVNSVAELSASDWGGFFKDANYISFASPTQSSTGTNVLNIGFENDPVFRVLDGTTFSTASMGKHDKPHDSTTDNIVNFNDNYASTAQNLVPFSIVNPLNWSAHSSLGYADGLNRVIDSKFYNLTSQDSTIIVSNLEASSRGKTWVEDLGRSGEPHTGSTFIIGTDSNDWLKGGAGNDFLEGRAGDDLFRDDGGFNILLGGQGHNTFDLQKPLQNFSFANDGDGTLYVRDAYGGISMTRDIGAIVSKESGSMWSSKEITWTVTGKGLANGAELTQYNHSLNGGALGDTLKATADGDWLFGLGGDDHLVSDKAHVTFVGGTGNDVMNAVGGNNTFLFSGAFGFDSIHGYQGSDKLVFMGVQGAGQGYDYKQHASQSGADTVLKIGDYAVTLIGVGVANLSDSSFVFA

SEQ ID NO: 271 - DNA, 756 bp, Unknown
  Obtained from environmental sample
gtgcttgtcgtgcatggttttgtggaaaacttcctctattttaccgaatactatgccgacccagaccttgagctgattctgctgaccagcgcggattaccatgtgcctgtcacccaggccacccatcagcaagctgcctgggccaaggcacccaaagagcgcctgggaactattgcctatgatgctgaggttttaattctggggttggaacacctggtcaatggccaggaagtgcgtgtgcacggccattcccgcggtggtgctgtggtactggaagccgcccgtcgtcgcccggatctatttgagcaggttgaagtgattcttgaggcacccgtgttgcctcagggcaaaccttatgccgaactgccccccagcgtgcgctggttcctgccctttgtactgcccttctggcaacagcaacccatctcgccccgcaacaaggccatctgggggccgctggatgatcggcgcaaacgctctctgatcatggggctgccgttcaaccccaaacattgcagcatcctcatggccaacattaaggatatggcggaatggatgccgggcaatggcagtgagctgtatcagaacgttaaacgtggcgccattctagtgcctggcaatgacaaggtgctggagccccgcgccatgctcgccagtgcccgacaggcagaaaatctgcaagtgattgaaatcgaaaacggcagtcattttgttatccctgaccaccctgattcgattccgcccttgccggcatga

SEQ ID NO: 272 - protein, 251 aa, Unknown
  Obtained from environmental sample
MLVVHGFVENFLYFTEYYADPDLELILLTSADYHVPVTQATHQQAAWAKAPKERLGTIAYDAEVLILGLEHLVNGQEVRVHGHSRGGAVVLEAARRRPDLFEQVEVILEAPVLPQGKPYAELPPSVRWFLPFVLPFWQQQPISPRNKAIWGPLDDRRKRSLIMGLPFNPKHCSILMANIKDMAEWMPGNGSELYQNVKRGAILVPGNDKVLEPRAMLASARQAENLQVIEIENGSHFVIPDHPDSIPPLPA

SEQ ID NO: 273 - DNA, 2244 bp, Unknown
  Obtained from environmental sample
atgaaagcacgtcgatcgttgagacaagccggatgcgcaaggttttttttattgctgatcattttgttgtttggctctcagcagctatgggcccagggatcaggatcttcgacgcataagaggccaaagatcgcattggttttaggcggcggcggcgccaggggcgctgcgcacatcggcgtgctcaaggtgctcgaggcgaacaggataccgatcgatctggtggtgggcacgagcatgggctctattgtcggcgggctgtatgcatcaggcatggctccggaagagatcgaaaagcagatcaacgccatcgactgggtcgagatgttccaggaccggccggatgaacagcacctttcattcagaaataagaaggaccagcagcgccttacttccatagagatggggatcaaagacggcggtgtagcgcttccttttggcgttatggcagggcagaagctgggttttgttttaaagaaaataacgctcccggttgctgagatcactgattttgacaagctctctataccttttcgcgcggtgtccaccaatctgcgctccggagagagagtggtgcttaaaaacggcagccttgcagaggccatgcgcgccagtatgtccattcccggcgtttggccgccggttgagcgcgaagggctgatcctggttgacggatttctggtatgcaacgtgcccgtagaggtcgccaaagagatgggagcggatatcattattgcggtcagcgtggatgctccgctggccccggataagaagttcgggtctttgatcgacgtgatcggccagatgaccgcgatctttgcccagcagaacgtcgaaaagtcgcgttctctgatcgatgataacgatttatacctcaatccggaccccggcatctcgcccggtgattttattaaaatgcctgacgcgatcaagataggtgcggaatcggcccaggcagttgtcgataaacttaagcgttactctgtatccgaatcagaatataaattattccttgctcagcagcgaaggcagggtacttatcaggagaccattcaggagatcaggattacgggcttaagccgagtttccgagcctcaggtgaggggcagaatgcagactcaggccggcaagcctttagatgttgtgaagcttcaggatgacatcaccaggatttatgctatgggcgattttgagtccgttgattttaagctgctggatgaaaacggcaagaacgtccttgtgatcgttcccaaagaaaaaccatggggccccaagtatttgcgtttcgggctcaatcttgccggcaataccagcgcacggaacgaattcggcacgcttttcgattttcgtatgaggcagatgaacgagctgggcgctgagtggaagaacgttctggaaatgggagcgacccggggcatcttcagcgagtggtaccagccgctcgatacgcgggattattttttcgttgccccgtttctcaaggcacagcggaatctcgccgatgtatatgacggcgatcaacgcaccgctacctatgaaaagaaatatatgggcgggggactgggtgccggggtgaatttcaagtcatacgcccaggcgcgagttgattatattgcaggcgtgatcaatgccaagccggacaccggaggcgcagggcttccgactttcagcaacaccaaggagggcgcgctgcaatttacgctcgacttcgaccagctggataaccataaattccccaaaaacgggtttaagatggtcacgaaatattacgaatcagctgattcgctgggaggagattactcctacaaaaaggcggagatctttttaggaaaagccactactccgatacccaggcatagcattcttaccatgttgacaataggaacgacgtttgataacaatgcgccgtattacgataaatatacgctgggaggttttttaaatcactccggctacagcgatcgccagctggtcggccagcataaaggattaggccagctgctgtattactataaattcggcaaagacccgatgggctcaggaggcaacctgtatctgggagccggagcggaatacggcaatgcctttgagaggtggcatgatacgaagttagacgatatgctcctcagcggattgctttttatcggcctcgattctccgttaggcccgatgtatatctcattcgcccagggcgaaggagactcagaaggccggatctatctgtatctgggaaagacattctga

SEQ ID NO: 274 - protein, 747 aa, Unknown
  Obtained from environmental sample
  SIGNAL (1)...(31)
  DOMAIN (46)...(237): Patatin-like phospholipase
  DOMAIN (376)...(747): Surface antigen
MKARRSLRQAGCARFFLLLIILLFGSQQLWAQGSGSSTHKRPKIALVLGGGGARGAAHIGVLKVLEANRIPIDLVVGTSMGSIVGGLYASGMAPEEIEKQINAIDWVEMFQDRPDEQHLSFRNKKDQQRLTSIEMGIKDGGVALPFGVMAGQKLGFVLKKITLPVAEITDFDKLSIPFRAVSTNLRSGERVVLKNGSLAEAMRASMSIPGVWPPVEREGLILVDGFLVCNVPVEVAKEMGADIIIAVSVDAPLAPDKKFGSLIDVIGQMTAIFAQQNVEKSRSLIDDNDLYLNPDPGISPGDFIKMPDAIKIGAESAQAVVDKLKRYSVSESEYKLFLAQQRRQGTYQETIQEIRITGLSRVSEPQVRGRMQTQAGKPLDVVKLQDDITRIYAMGDFESVDFKLLDENGKNVLVIVPKEKPWGPKYLRFGLNLAGNTSARNEFGTLFDFRMRQMNELGAEWKNVLEMGATRGIFSEWYQPLDTRDYFFVAPFLKAQRNLADVYDGDQRTATYEKKYMGGGLGAGVNFKSYAQARVDYIAGVINAKPDTGGAGLPTFSNTKEGALQFTLDFDQLDNHKFPKNGFKMVTKYYESADSLGGDYSYKKAEIFLGKATTPIPRHSILTMLTIGTTFDNNAPYYDKYTLGGFLNHSGYSDRQLVGQHKGLGQLLYYYKFGKDPMGSGGNLYLGAGAEYGNAFERWHDTKLDDMLLSGLLFIGLDSPLGPMYISFAQGEGDSEGRIYLYLGKTF

SEQ ID NO: 275 - DNA, 1260 bp, Unknown
  Obtained from environmental sample
gtgattaaagagattttactggccgatacccataactatcacggtattttagatgaacgttttattgatttagctcaccagttcagccgtcttcaagatgctagaacaggacaaggtggagctgctttagcggtttattttagaggtcagaaagttgtagatatctacaccggtctaaaatcacaaactgaagcttggcaacctgatactttggcagtttgctactctacagggaaaggtgtacttgcaaccttagcacatattttagtcagtgaaggttttttagaatatgacaaaccgattgcgacttactggcctgagtttgctcagaatggtaaagagcaaatgactttgcgtcatgtcctaagccatcaaagcggcatgtttgatattcgaaatattattgaaagtgcgagggaaatgctcgactggcgacatatgttggatgtaatggctatgtccaagccaagattcattgcaggacagggcaacgcttatcaagctttaacatttggttggcttgttggtggagtacttgaaaaagcaactggtcaatctttagatcaactcatgcaaaaatatctcattgaaccgttgcagttagatggtgcttattttggtacgcctgcaagccagttggaacgggtagctcgtttaattattcaaccgaaaccagaaaaaccagcatctgctcaagctgaaaaacctaacaaacctcagccacgcaaaagttcactttctgaaaaaatgattacatggactgggcaggacccgcaagattttcaggatgctatgattccaaaaggaatgaagaattttagtttctttagtgatgaaggattgcaagctgttattccagcagcaaatggtacatttactgcgaatagtcttgctaaaatttatgcgatgctggcaaataaaggcgaatgggatggacagcaactcattcgcccagaagtatttaaagagctgagtaccattcaaagttatgcacgtgatcgtgtcatgccaataccgatgaattggcgcttaggatatcaccgtattattacgatgggtaaacgtgctaaaaatggctttgggcatattggctacaatggttcaggggcatggtgtgaccctgagcgtgatcttagctttgcttatacccataactttcagattggttcaatcacgggtgactatcgtttatggggattgactcaagaaaccttacgctgcactgaccaagttttaaaagggcgtaaaggttggttctaa

SEQ ID NO: 276 - protein, 419 aa, Unknown
  Obtained from environmental sample
  DOMAIN (28)...(403): Beta-lactamase
MIKEILLADTHNYHGILDERFIDLAHQFSRLQDARTGQGGAALAVYFRGQKVVDIYTGLKSQTEAWQPDTLAVCYSTGKGVLATLAHILVSEGFLEYDKPIATYWPEFAQNGKEQMTLRHVLSHQSGMFDIRNIIESAREMLDWRHMLDVMAMSKPRFIAGQGNAYQALTFGWLVGGVLEKATGQSLDQLMQKYLIEPLQLDGAYFGTPASQLERVARLIIQPKPEKPASAQAEKPNKPQPRKSSLSEKMITWTGQDPQDFQDAMIPKGMKNFSFFSDEGLQAVIPAANGTFTANSLAKIYAMLANKGEWDGQQLIRPEVFKELSTIQSYARDRVMPIPMNWRLGYHRIITMGKRAKNGFGHIGYNGSGAWCDPERDLSFAYTHNFQIGSITGDYRLWGLTQETLRCTDQVLKGRKGWF

SEQ ID NO: 277 - DNA, 1509 bp, Unknown
  Obtained from environmental sample
atggtcaatcccagtattccactgattgaaacggtacagggccagttgatgggtgtcgtacaggatgacatccatctctggcgcggtattccttacgccgcgccaccgacgggagaacgtcgctggcgagcgccgcagccggtcactccctggtcagggattcgtaatgcgaataccttctccagcgccagctggcaggacattgagtactgcaaagagttgggcggcggcgatcccggcgcattttctgaagattgtctctatctcaacgtctggtctccggcggagcgacatcagccgcttccggtgatggtctggctgcacggtggcggctacaccattggtgccggcaatctgccgccttatgacggcgttgcgctggcgaagcgtaacgtggttgtcgttaccgtcaactatcgcttgggtcatcttggcttttttgcccatccggcgctggaaggtgaagagagtgaggctctcaataactttgcgctcctcgaccagattgctgcgctgcgctgggtacaggaaaacatcgccgcgttcggtggcgatccgcagaacgttacgctgtttggtgaatcggccggggcgcgtagcgtgctctcgctgttagcttcgccgcgaggaaaagggctgtttcataaagcgattgtccagagcggctacacgttgccggacacgcctcgtgaaatagcgctggaaaacggcgttgcgctggctgaacattttggcttgcagaatgcgacggcggaacagctacgcgcgattccggccgaggccttctggccgctgggcgcaccgtacaaaattgcgccgacacctatctccggcgatgcggtactgccggagccaatgctggacgtctttttcgccgccagacagcacccgatgcccgtcatgattggttctaacagcgatgaagccagcgtgatggccgtcttcggcgtcgatcttgccggacaaattcagaaactgcgtcgtgaacgcaggctgggactcggcctgattaagctgctgtatccgggcgtgaagggcgatgaagaactggggcgacaggtgtgtcgggatatggcgtttacggcattaggctatgtggtgatgcaggcgcaacagcgggtcggcgagccgtgctggcgttactggttcgattacgttgcggaatcggagcatcacacctatgccaacggcgcctggcatggcaacgaagtgccttacgtctttaataccttaacgctcgctgaaccttcgcgaaattatgtgaacgaaaacgatctcgccttcgctgtccacgttgcggattactgggtcaattttgcccgtcatgccagtcggacctgcgatgttctgcatggcccggtccgctggcctgcctgtattcagggccgcgatcgggtgttacgtattgggctgaaaaagtttgccggttttaaggtcgagaaccggtttatgcgggcgcggctttcgctctttaaacgggtgatggcccagcacgtcagtctcgactag

SEQ ID NO: 278 - protein, 502 aa, Unknown
  Obtained from environmental sample
  DOMAIN (2)...(482): Carboxylesterase
MVNPSIPLIETVQGQLMGVVQDDIHLWRGIPYAAPPTGERRWRAPQPVTPWSGIRNANTFSSASWQDIEYCKELGGGDPGAFSEDCLYLNVWSPAERHQPLPVMVWLHGGGYTIGAGNLPPYDGVALAKRNVVVVTVNYRLGHLGFFAHPALEGEESEALNNFALLDQIAALRWVQENIAAFGGDPQNVTLFGESAGARSVLSLLASPRGKGLFHKAIVQSGYTLPDTPREIALENGVALAEHFGLQNATAEQLRAIPAEAFWPLGAPYKIAPTPISGDAVLPEPMLDVFFAARQHPMPVMIGSNSDEASVMAVFGVDLAGQIQKLRRERRLGLGLIKLLYPGVKGDEELGRQVCRDMAFTALGYVVMQAQQRVGEPCWRYWFDYVAESEHHTYANGAWHGNEVPYVFNTLTLAEPSRNYVNENDLAFAVHVADYWVNFARHASRTCDVLHGPVRWPACIQGRDRVLRIGLKKFAGFKVENRFMRARLSLFKRVMAQHVSLD

SEQ ID NO: 279 - DNA, 1245 bp, Unknown
  Obtained from environmental sample
atgttctggttggcacttatctgggccctgctggccctgaatctgtattacccctggaagggcaaacccgaggtcggtggcgtgatcagcttcgccttcgggctgttggtgggcgaactcgccttgcatgtgattgcgctgcaagttctcactaccctgctgtttatcaccttctgcggcctgtcaggcttcggcgatgcgctggggctgatgctcgccatggccacctggctggcgatggcctggttctacgcacgcagcgagcgcgcggggcccgcgatggagagcggcattcgccaggccctgggcgaagactattcaaaactgatttcggccgagcgcagcgactgcctgcaccgcgacatagattatcggcagctgcttaacccctttgccttcagcaaacccgaagtgacccgacaccgcaatctgccctacgcggaagtggacggcaaaaacctttatttggatatcttccaccaccgcgacaagccacaaaacgcgccagtactgctgcaaattcacggcggcgcctggctgcagaatctgggcaacaaggatcagcaggcgctgccgctgatgaatgaactggccagccgcggctgggtgtgcgtgacggtgcaatatcggctgagtcccggcgtcaccatgcccacccatattattgactgcaagcgcgcgctggcctgggcgaaggagcatatcgctgattacggtggcgatccgaacttcattatcgtcaccggcggttccgctggcgggcatctgtcagcgatggtggcgctcaccgccaaccagcccgaattccagccgggtttcgaggacacggatacccgcgtacaaggtgccgtacctttctacggtatccacgactttaccaacagccgtggtcagcgcgagcataaggggctggagaacttcatcgcgcaacgcgtaatgaaagtgacccgctacgataaccccaaactgtgggagcaatgctctcccctgtttcaggtaaaagacgacgcgcctccgatgctgttggtacacggcgaggccgataccctggcaccgatcagcgaatcgcaggccttgctggaggttttgcgggaacacgacgtcaaagcggggctggcggcactgcccgatgcgcagcacgccttcgaactgatgtactcgctgcgcaccctgtatatgattaatgccgtggagcgcttcggcaacgcactgcacggcaagtatctacaggatggcgcagcttaa

SEQ ID NO: 280 - protein, 414 aa, Unknown
  Obtained from environmental sample
MFWLALIWALLALNLYYPWKGKPEVGGVISFAFGLLVGELALHVIALQVLTTLLFITFCGLSGFGDALGLMLAMATWLAMAWFYARSERAGPAMESGIRQALGEDYSKLISAERSDCLHRDIDYRQLLNPFAFSKPEVTRHRNLPYAEVDGKNLYLDIFHHRDKPQNAPVLLQIHGGAWLQNLGNKDQQALPLMNELASRGWVCVTVQYRLSPGVTMPTHIIDCKRALAWAKEHIADYGGDPNFIIVTGGSAGGHLSAMVALTANQPEFQPGFEDTDTRVQGAVPFYGIHDFTNSRGQREHKGLENFIAQRVMKVTRYDNPKLWEQCSPLFQVKDDAPPMLLVHGEADTLAPISESQALLEVLREHDVKAGLAALPDAQHAFELMYSLRTLYMINAVERFGNALHGKYLQDGAA

SEQ ID NO: 281 - DNA, 1254 bp, Unknown
  Obtained from environmental sample
atgaaagcgaaagttcaatttttcatcgctgttggttttattttttccatgtttactactccttttgtaacaaaggcacaagcggaaccttcagctcaatcaattggaaatgactatccgctcatactcgttcatggattaactggttggggcccggaggaaatgttaggcttcaaatattggggcggacataatgacatcgaagctcttttgaataacaatggccacagaacatttactgctgcggttggtccagtttcgagtaactgggatcgtgctgtggaactctattattatattaaaggcggaacagtagattatggcgcagcacatgcaaaagagcatggtcactcacggtatggtcggacacacactggaatctacagcgagtggaatggaataaataaaattcatctagttggtcatagcatgggtggacaaacaatacgaacgttaagtgatctattgatagatggaagtgctgatgaaaaggattatcataaggcgcatacggaagagggaatttctccattatttgaaggagggaagaattgggtccatagcataacaagtatcgcttcacctcataatggatctacttttgcagataaggaagaaatgatagacttcatcaagaagatggtaattgatatggctactctctcggggattaacagcagagataacattgtctatgattttaagctggatcaatggggactgaaacgcaatccaggtgaatcattcacttcatatatggaacgagtcatggagagttctatttgggagagtaaagatattagtgcatttgatttaaccacttggggtgcagcagaacttaatagctgggcagatacaaacccaaatatgtattatttctcctatacaggtaatgcaacatatcgtttgttaacaggtcgttattatccgatggggacgatgaatccgatgttgtggagttctagtcttcacataggatcatataccagaaatagccctgcacctgtaatcgataaaacctggtggccgaatgatggcttagtgagtgtagtatcgggaaaataccctttcaatcatccattcaagcagtttgatggcgtggctgagaagggcgtatggaattaccatcaagtacaacttgcatgggaccacctagactatgttggcatcagtgctgcccacctaataggtattagagaaattaatagtttctataacaatatggctaatcagcttcatagtctgccgaggtaa

SEQ ID NO: 282 - protein, 417 aa, Unknown
  Obtained from environmental sample
  SIGNAL (1)...(28)
MKAKVQFFIAVGFIFSMFTTPFVTKAQAEPSAQSIGNDYPLILVHGLTGWGPEEMLGFKYWGGHNDIEALLNNNGHRTFTAAVGPVSSNWDRAVELYYYIKGGTVDYGAAHAKEHGHSRYGRTHTGIYSEWNGINKIHLVGHSMGGQTIRTLSDLLIDGSADEKDYHKAHTEEGISPLFEGGKNWVHSITSIASPHNGSTFADKEEMIDFIKKMVIDMATLSGINSRDNIVYDFKLDQWGLKRNPGESFTSYMERVMESSIWESKDISAFDLTTWGAAELNSWADTNPNMYYFSYTGNATYRLLTGRYYPMGTMNPMLWSSSLHIGSYTRNSPAPVIDKTWWPNDGLVSVVSGKYPFNHPFKQFDGVAEKGVWNYHQVQLAWDHLDYVGISAAHLIGIREINSFYNNMANQLHSLPR

SEQ ID NO: 283 - DNA, 966 bp, Unknown
  Obtained from environmental sample
atgacggctgttctgatcggcgcgggggttctggcggggctcatcctcgccgtgctggcgggtttcgcggcgttctcgcgccatgtcgcgcgcaaggtggaggcggcgctgccggcgcgcgggcgtttcaccgcggtgacgggcgggcggattcactgggtggaggcgggctcagggccgcccatcgtcttcatccacggcctcgccggcaatctgcacaatttcacccattcgctcaccgaccgcctgaccggcgatttccgcgtcatcgtcatcgaccggccgggctgcggttggtcggagcgggacggggatgggcgcgcccggctgccggagcaggcgcggatggtcgcggaattcctggaggcggaggggatcgagcgcccgctggtcgccggccattccctcggcggcgccgtggcgctgaccctcgcggttctgcatccggagcgcgtcggcgggctcgccctgatcgcgccgctggtcgcgcgggtgacggacccgccggcggtgttccgcggcatcgcgctggaaaactcaggtctgcgccgcctcgtcgcgctcacgctcgccgcgccgatggggatccgcaacggcccgaaaaccctcgccgccatcttcgcgccggatgcggccccgaaggatttcgcgatgcgcgccggcggcgttctgggtctcagacccgccggtttctacgccgccgcgaccgacctctacgccgcgccgctcgacatcgaggcgatcggcgcgcgccatggcgagatcgcctgcccggcgggcattctctatggcgacgccgacgcggtgctggacgcgcagacccatctcggcgcgctcgccgcggccctgcccggcgcggaggcggagatcatccccggcgccggccacatgctgccgatctcgcatgcggatgagacggaggcgttcatgcggcggatggcggggcgggtgttttcggggagatga

SEQ ID NO: 284 - protein, 321 aa, Unknown
  Obtained from environmental sample
  DOMAIN (87)...(312): alpha/beta hydrolase fold
MTAVLIGAGVLAGLILAVLAGFAAFSRHVARKVEAALPARGRFTAVTGGRIHWVEAGSGPPIVFIHGLAGNLHNFTHSLTDRLTGDFRVIVIDRPGCGWSERDGDGRARLPEQARMVAEFLEAEGIERPLVAGHSLGGAVALTLAVLHPERVGGLALIAPLVARVTDPPAVFRGIALENSGLRRLVALTLAAPMGIRNGPKTLAAIFAPDAAPKDFAMRAGGVLGLRPAGFYAAATDLYAAPLDIEAIGARHGEIACPAGILYGDADAVLDAQTHLGALAAALPGAEAEIIPGAGHMLPISHADETEAFMRRMAGRVFSGR

SEQ ID NO: 285 - DNA, 408 bp, Unknown
  Obtained from environmental sample
atgggaacggtgatcggatcggaactcctggcgcaggcgctcaaggcgcagggcgtggatacgatgttctacgtcatgggcggcccgatgctcgagacggaggcgaccgccatcaagctcggcatccgggcgatcgacacccgccacgagcaggcggccgcgctcgcggcgcatgcgtggacgcgggtgatgcgccgccctgcggtggccatgggctgctccggccccggcgccacgaatctcttgaccggcgtggcgaacgccttcaccgatgcagccccgctcgtggccatcggcggcgccagcccccgcgtgtcgctcaacatggaggcgttccaggagatcgaccaggtggcgatcatgcggcccgtcaccaagtgggcccagcgcatctacgacgcccggcgg

SEQ ID NO: 286 - protein, 136 aa, Unknown
  Obtained from environmental sample
  DOMAIN (2)...(136): Thiamine pyrophosphate enzyme, N-terminal TPP binding domain
MGTVIGSELLAQALKAQGVDTMFYVMGGPMLETEATAIKLGIRAIDTRHEQAAALAAHAWTRVMRRPAVAMGCSGPGATNLLTGVANAFTDAAPLVAIGGASPRVSLNMEAFQEIDQVAIMRPVTKWAQRIYDARR

SEQ ID NO: 287 - DNA, 996 bp, Unknown
  Obtained from environmental sample
atgaagcggatttctgggatattgagggttattggggtgattttgttgcttttgctggcaggactgctggttgtcccattgatcttgcctgtaccccctttgcaggacatccggaatgtaaatgaattaaaagacccagacagccagttcatccagatccagggtattcaggtccactacaagaagtacggtgccggtgaacccgcgatcattttgcttcatgggtttggcgccagtacgttttcctggcgggaggtggtggaaccactttctgttcatggtacggtcattgcttacgaccgccccgcctttgggttgaccagccgtcctatgcccaaagactggcagggtataaatccgtacagcgttgaaggcaatatttctcttttggttggattaatggatcgtcttggagtcaatcaggcaatcctgattggaaactcagcggggggcaggctggcaatgcagatggctctggctcatcccgaacgagtttctgggttaattctggtagatgccgctatttatcagggtggaggagttcagtcatcattcattcgtgccctcatgaacactcctcaattgaaccgcattggaccttatttgttgagatctgcttttgcaggcgagcagggacaatccctgatttcaatggcttggcacgatccttcgaaattaaccccagaagtaatagaaggatatcgcaaacctcttcatatggaaaactgggatcgcgccttgtgggagtttaccaaagcaggcagcggtagtgaagatctctccctccgttttgctgaattgaccatgccggtactcgtcgtgaccggggatgatgatcgtatcgtacccacatcgctcagcctgaaactggctgaggaaattcctcaggcgcaactggtagttttttcaaattgtggccatgttccacaggaagaatgccctgatcagtttttgaaagcagttgaagaatttcttggcaggtataaatttcaatag

SEQ ID NO: 288 - protein, 331 aa, Unknown
  Obtained from environmental sample
  DOMAIN (94)...(323): alpha/beta hydrolase fold
  DOMAIN (48)...(329): Ndr family
MKRISGILRVIGVILLLLLAGLLVVPLILPVPPLQDIRNVNELKDPDSQFIQIQGIQVHYKKYGAGEPAIILLHGFGASTFSWREVVEPLSVHGTVIAYDRPAFGLTSRPMPKDWQGINPYSVEGNISLLVGLMDRLGVNQAILIGNSAGGRLAMQMALAHPERVSGLILVDAAIYQGGGVQSSFIRALMNTPQLNRIGPYLLRSAFAGEQGQSLISMAWHDPSKLTPEVIEGYRKPLHMENWDRALWEFTKAGSGSEDLSLRFAELTMPVLVVTGDDDRIVPTSLSLKLAEEIPQAQLVVFSNCGHVPQEECPDQFLKAVEEFLGRYKFQ

SEQ ID NO: 289 - DNA, 966 bp, Unknown
  Obtained from environmental sample
atgacgccgcgcggggcgagccgagcgctcgcactcctgaccgtgggcctgaccttgctcgcctgcgcgcccgcaccgccggggccggctggcgccgtgccgagcacaccgacgcgcgcctggctgccgaacgatgcgccgccgcgggcggcgatcctggcgctccacggcttcaacgactacagcaacgcattcgcggatttcggcgcctatgtggccgcgcgcggcgtcgcggtgcacgcctacgaccagcgggggttcggcgccaacgcggacgcgggctactggcccggcgtcccggtcatggtggcggatctgcggcgcgaggtggagcggctgaaagagctctacccggagctgccgatctacgtgctgggcgagagcatgggcgcggcggtggtgatcgcggccgccgcccggggcgagtcgcccgacgtcgccggctcgatcctggcggcgcccgccgtctggggcggagagcagctgaacccgctctatcgcgccaccttgtggatcgcggtgcagctggtcccgaacatgcggctcaccgggcgcgggctcgaggtgctggcctccgacaacatcgacatgctgcgcgcgctcggcgaggacccgctggtgatcaagggcacccgggtgaacgcgatcgcggggctggtcgggctcatggacctggccctgcccggagcggccgccgtgcccggcccgcttctggtgctgggcggcgcccgggacgagatcgtgccgccgcgcgcgcacgcggccatgctcgagcgcctgaccgcgcagccgtgcaccgaggtggtctatcccgagggctggcacatgctactgcgcgacctgcagcggcgggtggtctgggacgacatcctggcctggatcgacggcgagccgctgccgtccgagttcgacggcccctgcgggatcgacctcaggtcggtcgtcgcatcgctgccacgatcctga

SEQ ID NO: 290 - protein, 321 aa, Unknown
  Obtained from environmental sample
  SIGNAL (1)...(32)
MTPRGASRALALLTVGLTLLACAPAPPGPAGAVPSTPTRAWLPNDAPPRAAILALHGFNDYSNAFADFGAYVAARGVAVHAYDQRGFGANADAGYWPGVPVMVADLRREVERLKELYPELPIYVLGESMGAAVVIAAAARGESPDVAGSILAAPAVWGGEQLNPLYRATLWIAVQLVPNMRLTGRGLEVLASDNIDMLRALGEDPLVIKGTRVNAIAGLVGLMDLALPGAAAVPGPLLVLGGARDEIVPPRAHAAMLERLTAQPCTEVVYPEGWHMLLRDLQRRVVWDDILAWIDGEPLPSEFDGPCGIDLRSVVASLPRS

SEQ ID NO: 291 - DNA, 1851 bp, Unknown
  Obtained from environmental sample
atgcccgtattcgattaccgacagctcgacagcactgcctcctctgcgctgtacaaggacgccatggcgctggctacctacgcctaccatggcatcgacgatggcttcagcgccggctaccagaagtacggcttcggccttggcctgccggccacgctggtcaaggcgctgatcggcggcaccgacagccagggggtgatccccggtattccctggaaccccgactccgaagccagggccctggcccaggtaaaggccgccggctggtcgccgatcagcgcggcgcaactgggctaccagggcaagaccgacgcccgcggtaccttccacggcgaagcgccgggctacacctcggcgcaggtggagatcctcggccgctacgatgccgccggccagctcagcggtatcggcatcgctttccgcggcaccagcggcccgcgtgagaacctgctgggcgacaccatcggtgacgccatcaacgacctgctggcggcgatcggcccggcaggctatgcccgtgattacgccggtaacgcattcgggcagttgctcgccgatgtggccgcctttgccaaggccaatggcctgagcggcgcggacatcaccgtcagcggtcacagcctcggcggcctggcggtcaacagcctggccgacctgagcggctcgcgctggggtggtttctaccaggatgcgcgctacgtcgccttcgcctcgccgacccaggccgccgacgccagcaaggtgctcaatatcggctacgagaacgacccggtgttccgtgtgctcgatggcacctcggcgacctggggcaccctgggcgtgcacgacggcgccaaggcctcggccaccaacaacatcgtcaacttcaatgaccattacgcgtccgacgcctggaacctgctgccgttctccatcggcaacatcgccacctggctgtcgcacctgccgacggcctacaccgatggccttgggcgtgtgctggattcctccttctaccagtggaccagccgcgactcgaccatcctggtcagcaacctgtcggacgtgacccgtggctcgacctgggtcgaggatctcaaccgcaatgccgagccgcacaagggcagcacgttcattatcggctcggacaaggacgacctgatccatggcgggcgcggcaacgactacctcgaaggccgggccggcaacgataccttccgcgatgacggcggtttcaacctgatcgacggtggcgccggccatgacaccctgaagctgcaggatgccttggccaacctgagcatcgcccgggatggcgaaggcacgctgtacgtgcgtgacgccgagggcggcatcagcctggtgcgcaatgtcgaaaacctggtgagcaaggagtcgagcctgctgatcttcagcaaggaagtcagtcacggggtggcggcgcaggggttgttcgaaagcggcaaggtcaccccctatgcgtcctcgctcaacggcacccaggcaggcgaccagctggtggcgggtaatcaggggcagtggctgttcggcctgggcggtgacgaccgactgcagggcggcgccggcaatgacgtgctggtcggcggcacgggcaacgatgtgctgatgggtggcggggggcgcgacaccttcctgttcagcggccatttcggccaggaccgggtgctggacttcaccggccaggatcgactggtgttcattggcgtggaaggcggcaccgccgcgccggactggcgtgcccatgccagccaggtgggggatgacctggtgctgaagttcggcggggacagcgtgacgctggtggggattgcggggcagggcgttggggatgggcagatcgtgatcgcctga

SEQ ID NO: 292 - protein, 616 aa, Unknown
  Obtained from environmental sample
  DOMAIN (133)...(266): Lipase (class 3)
  DOMAIN (382)...(399): Hemolysin-type calcium-binding repeat (2 copies)
MPVFDYRQLDSTASSALYKDAMALATYAYHGIDDGFSAGYQKYGFGLGLPATLVKALIGGTDSQGVIPGIPWNPDSEARALAQVKAAGWSPISAAQLGYQGKTDARGTFHGEAPGYTSAQVEILGRYDAAGQLSGIGIAFRGTSGPRENLLGDTIGDAINDLLAAIGPAGYARDYAGNAFGQLLADVAAFAKANGLSGADITVSGHSLGGLAVNSLADLSGSRWGGFYQDARYVAFASPTQAADASKVLNIGYENDPVFRVLDGTSATWGTLGVHDGAKASATNNIVNFNDHYASDAWNLLPFSIGNIATWLSHLPTAYTDGLGRVLDSSFYQWTSRDSTILVSNLSDVTRGSTWVEDLNRNAEPHKGSTFIIGSDKDDLIHGGRGNDYLEGRAGNDTFRDDGGFNLIDGGAGHDTLKLQDALANLSIARDGEGTLYVRDAEGGISLVRNVENLVSKESSLLIFSKEVSHGVAAQGLFESGKVTPYASSLNGTQAGDQLVAGNQGQWLFGLGGDDRLQGGAGNDVLVGGTGNDVLMGGGGRDTFLFSGHFGQDRVLDFTGQDRLVFIGVEGGTAAPDWRAHASQVGDDLVLKFGGDSVTLVGIAGQGVGDGQIVIA

SEQ ID NO: 293 - DNA, 858 bp, Unknown
  Obtained from environmental sample
atgcacttccttgcgcctcaaatcagggacgactttgagaaccagaacggaccgatcaagatccgccttagccatcctgaatccaaacagcctcccatactttttgtaccagggtcattctctggagcatggatttggcaaggaaacttcttcgagcattttcatcaagccggttacgacgttgcggcaatgagcttctctgggcatggtcagcagggttggccgttgtggcgacggggtttgtctgcatttgagcgtgatctcgagatggctattgagcaattcgaaacccctccgatattgattgcacactccctgggcggcttgatagcccaacgggttgcgtaccgggtgcgtgttagggcattggcactactatccccgatccctttacatggtctcgcaggtagcgcgctttcattggcgaagaagtcgccaatcagtattcttaagcttgcagcagtatctcttgagccgagacttgcacgcctaggcgagcctccgctgggaatctattcaccccatgtcgggcagaaagtacgcaccgctatcactggaagattacaggccgagtccccttttgcactcatgcagagccttcttcctaactccaatgccacacactcgactccatgccccattcacttctggggtgccgagggggatcacataattccggcaaatgaagttcggcgtgccgcccaagcaatgtgggctccatcaaaaatattcccgggcatgagtcacacaatacaagccgaaccgaactggcaaatggttgccgaccatgttctgaagtgggtcgaaaaacagggtcaaaaactgcaaaaacgcggggctaaagcacgtcaacagtga

SEQ ID NO: 294 - protein, 285 aa, Unknown
  Obtained from environmental sample
MHFLAPQIRDDFENQNGPIKIRLSHPESKQPPILFVPGSFSGAWIWQGNFFEHFHQAGYDVAAMSFSGHGQQGWPLWRRGLSAFERDLEMAIEQFETPPILIAHSLGGLIAQRVAYRVRVRALALLSPIPLHGLAGSALSLAKKSPISILKLAAVSLEPRLARLGEPPLGIYSPHVGQKVRTAITGRLQAESPFALMQSLLPNSNATHSTPCPIHFWGAEGDHIIPANEVRRAAQAMWAPSKIFPGMSHTIQAEPNWQMVADHVLKWVEKQGQKLQKRGAKARQQ

SEQ ID NO: 295 - DNA, 1050 bp, Unknown
  Obtained from environmental sample
atgataccaatggatgccggtttttcccgctcaaacaggatcgttatgagaatcagccttattcacgttgctttgctgctcggcccgcttttcccggttagcgcactttccgccgccgaccagctgcgccgcggcgaacgcaaggaaacaaccaaggccgaagccccgcgcaaggaggagaagaaggacgagccggcgcaatcgcccgtcgagatcatcaagaacatttcctaccgggacgatgaggccgccgacccgacgcgccacaagctcgacctgtacctgccgcgcggcgccaaggacttcccgattgtctttttcgtccacggcggcgcctggcgagccggcaacaaggatgagtatcccagacttggcgaattctttgccaccgagggcattggctgcgtcgtcatcaattaccgcctctcccccaaggtgcagcatcccgcccatattgaagacgtcgcccgtgccttcgcctggaccgtcgccaacatcgaaaaatacggcggccgtaaagatcgcattttcgccgtgggccactcggccggcggccacctggtcgccctgctggccaccgatgccacgtacctcaagaacgaaggactggcgctgaccgacattcgcggcgtgatccccattagcggcgtgcatcagatcaactcggccctgccgatgttccgtaacattttcagcagggacaaggaggagtgccggcttgcctcgcccatcacccatgtcagcaatggccacccgcctttcctgctcctttacgctgagaacgacctgccgctcttgggcaggatggccgaggacatgagcgaggtgctgaagaagaatcagtgcgatgtcgaatgcctgaagattgaccagcgcaaccacatgacgatcatcacccagctttcccaggaaaatgacccgacgcggcaagcggtcttcgacttcatcggccggcatagcgactggcagcccgcggccagggccgaggctgccaacggcaataagcgcgaagccggcacgacggacgccgctatgaaggacgacaaatga

SEQ ID NO: 296 - protein, 349 aa, Unknown
  Obtained from environmental sample
  SIGNAL (1)...(38)
MIPMDAGFSRSNRIVMRISLIHVALLLGPLFPVSALSAADQLRRGERKETTKAEAPRKEEKKDEPAQSPVEIIKNISYRDDEAADPTRHKLDLYLPRGAKDFPIVFFVHGGAWRAGNKDEYPRLGEFFATEGIGCVVINYRLSPKVQHPAHIEDVARAFAWTVANIEKYGGRKDRIFAVGHSAGGHLVALLATDATYLKNEGLALTDIRGVIPISGVHQINSALPMFRNIFSRDKEECRLASPITHVSNGHPPFLLLYAENDLPLLGRMAEDMSEVLKKNQCDVECLKIDQRNHMTIITQLSQENDPTRQAVFDFIGRHSDWQPAARAEAANGNKREAGTTDAAMKDDK

SEQ ID NO: 297 - DNA, 1500 bp, Unknown
  Obtained from environmental sample
  misc_feature (1387)...(1404): n = A,T,C or G
atgggcgtgtttgactataaaaaccttggggccgagggctccaaagcattgtttgccgatgccatggcgatcacgttgtatacctaccacaacctggataacggctttgccgtgggctaccagcacaatggcctgggcgtcggcttgccggctactctggtcggcgcattgctcggcagtacggactcccagggtgtgatcccaggcattccctggaacccggattcggagaaggccgcgctcgaagcggtgcagaaggctgggtggacgcccatcagcgccagcaccctcgggtataccggcaaggtcgacgcccggggcacgttcttcggcgaaaaggccggctataccacagcccaggtcgaggtgctgggcaagtacgatgacgcgggccagttgcaggaaatcggcatcggttttcgcggcacgtctggcccaagggagacgctgatcaccgactccatcggcgatctggtcagcgacctgcttgcggcgctgggtcccaaggattacgcgaagaactacgccggcgaagcattcggcggcttgctcaagaacgtcgccgagtatgcggcggcccacggtctgagcggccaggatgtgctggtcagcggccatagcctcggcggcctggcggtcaacagcatggccgacttgagcgacgccaagtggtccgggttctataaggacgccaactacttggcctacgcctcaccgacccagagtgccagcgacaaggtgcttaatatcggctacgaaaacgacccggtgttccgcgctttggacggctcatccgccaacctgtcgacgctcggggttcacgacaaaccccacgagtccaccactgacaacattgtcaacttcaacgatcactacgcctcgaccctgtggaatgtgctgccgttttccatcgccaatctgccgacctggatctcgcacttgccgaccggctacggcgacggcatggggcgcattctggagtcagggttctatgaacagatgaaccgggactcgacgattatcgtggccaatctatccgacccggcacgggccaccacttgggtgcaggacttgaaccgcaacgccgaaccgcacacaggcgacacttttatcattggcagcgatggcgatgatctgatccagggcggcaagggcgcggactttatcgaaggcggcaagggcaatgacacgatccgcgacagcagcgggcataacacctttttgttcaacggccagtttgggcaggatcgaattatcggttatcagccgacggataaactcgtgttcgagggtgtggcgggcagcggggattaccgtgatcacgccaaggtggtgggtggggatacggtgatcagtttcggggcggattcggtgacgttggtgggcnnnnnnnnnnnnnnnnnntggtcccccttccacagtgtgctttccttcagactggcgcttttgcgcgttgggatcagtcttctttgcggacggtggccacgtcatcggctttga

SEQ ID NO: 298 - protein, 499 aa, Unknown
  Obtained from environmental sample
  DOMAIN (133)...(265): Lipase (class 3)
  VARIANT (463)...(468): Xaa = Any Amino Acid
MGVFDYKNLGAEGSKALFADAMAITLYTYHNLDNGFAVGYQHNGLGVGLPATLVGALLGSTDSQGVIPGIPWNPDSEKAALEAVQKAGWTPISASTLGYTGKVDARGTFFGEKAGYTTAQVEVLGKYDDAGQLQEIGIGFRGTSGPRETLITDSIGDLVSDLLAALGPKDYAKNYAGEAFGGLLKNVAEYAAAHGLSGQDVLVSGHSLGGLAVNSMADLSDAKWSGFYKDANYLAYASPTQSASDKVLNIGYENDPVFRALDGSSANLSTLGVHDKPHESTTDNIVNFNDHYASTLWNVLPFSIANLPTWISHLPTGYGDGMGRILESGFYEQMNRDSTIIVANLSDPARATTWVQDLNRNAEPHTGDTFIIGSDGDDLIQGGKGADFIEGGKGNDTIRDSSGHNTFLFNGQFGQDRIIGYQPTDKLVFEGVAGSGDYRDHAKVVGGDTVISFGADSVTLVGXXXXXXWSPFHSVLSFRLALLRVGISLLCGRWPRHRL

SEQ ID NO: 299 - DNA, 945 bp, Unknown
  Obtained from environmental sample
atggctgatttgcacccaaaaatgaaatttttcctggagaatcttttgccaatccaggaaggagctgtacctacccttgaggaaattcgcgcaagaagtgctgcaatgccttcgggtacggtggaggaggtccaggaagtgtcagacagacttatccctggctctgaatccgacatcccagttcgcatttatactcctgaaggagagggaccatttccggtaaccgtatttttccacggcggaggatttgtatacgggggacttgatacccatgatgcggtctgcagaagcatcgtgaaggcttctggccagatggttgttgcggtagaataccggcttgctccggaaaatccgttccctgcagcacctgaagactgctttgcagccgcaaattgggtaaatgagaatgcagaaaagctaaacgctgaccgaactaagctaagcgtcgcgggagacagtgccggagggaatttggcaactgtagtctgcctgcttgcgagagagaggggaggcctgtctatcagcaagcaggttctgatctaccctgttacagataaataccagcctggaaaatatccgtcctatgaagagaatggaagcggctatttcctcacaactgactcgatggcattatttgcagccctttacattcaatctgaagagggacgtgacaatccgctttcggctccgatactggccaagaacttaagcgggctgccgcctgcactggtcattacggccgagtatgacccactaagggatgaaggcgaagcctatgctgaaaaactccgtgacgcgggagttgaagtgattttaaaaagggaagcaggccagattcacggctttttcaatctcttcagcattatggattccaaggatgatttaaaggacgtatatgcctatatcggcgagttcctaaatagtgaaatcgccgcagttctatag

SEQ ID NO: 300 - protein, 314 aa, Unknown
  Obtained from environmental sample
MADLHPKMKFFLENLLPIQEGAVPTLEEIRARSAAMPSGTVEEVQEVSDRLIPGSESDIPVRIYTPEGEGPFPVTVFFHGGGFVYGGLDTHDAVCRSIVKASGQMVVAVEYRLAPENPFPAAPEDCFAAANWVNENAEKLNADRTKLSVAGDSAGGNLATVVCLLARERGGLSISKQVLIYPVTDKYQPGKYPSYEENGSGYFLTTDSMALFAALYIQSEEGRDNPLSAPILAKNLSGLPPALVITAEYDPLRDEGEAYAEKLRDAGVEVILKREAGQIHGFFNLFSIMDSKDDLKDVYAYIGEFLNSEIAAVL

SEQ ID NO: 301 - DNA, 933 bp, Bacteria
atgccgctcgatcccgtcattcagcaggtgctcgatcaactcaaccgcatgcctgccccggactacaaacatctctccgcccagcaatttcgttcccaacagtcgctgtttcctcctgtcaagaaggagcccgtggccgaggtccgagagtttgacatggatctgcctggccgcacgctcaaggtgcgcatgtaccgcccggagggcgtcgaaccgccctaccccgcgctcgtgtattatcacggcggcggttgggtcgtcggagacctcgagacgcacgatcccgtctgccgcgtcctcgcgaaagacggccgcgcggtcgtgttctccgtcgactaccgcctggcgccggagcacaagttccctgccgccgtggaagacgcctacgacgcgcttcagtggatcgcggagcgcgcagcggactttcatctcgatccagcccgcatcgcggtcggcggagacagcgccggagggaatcttgccgctgtgacgagcatccttgccaaagagcgcggcgggccggccatcgcgttccagctgctcatctacccttccacggggtacgatccggctcatcctcccgcatctatcgaagaaaatgcggaaggctatctcctgaccggcggcatgatgctctggttccgggatcaatacttgaacagcctggaggaactcacgcatccgtggttttcacccgtcctctacccggacttgagcggcttgcctccggcgtacatcgcgacggcgcagtacgatccgctgcgcgacgtcggcaagctttacgcggaagcgctgaacaaggcgggcgtcaaggtcgagatcgagaacttcgaagatctgatccacggattcgcacagttttacagcctttcgcctggcgcgacgaaggcgctcgtccgcattgcggagaaacttcgagacgcgctggcctga

SEQ ID NO: 302 - protein, 310 aa, Bacteria
MPLDPVIQQVLDQLNRMPAPDYKHLSAQQFRSQQSLFPPVKKEPVAEVREFDMDLPGRTLKVRMYRPEGVEPPYPALVYYHGGGWVVGDLETHDPVCRVLAKDGRAVVFSVDYRLAPEHKFPAAVEDAYDALQWIAERAADFHLDPARIAVGGDSAGGNLAAVTSILAKERGGPAIAFQLLIYPSTGYDPAHPPASIEENAEGYLLTGGMMLWFRDQYLNSLEELTHPWFSPVLYPDLSGLPPAYIATAQYDPLRDVGKLYAEALNKAGVKVEIENFEDLIHGFAQFYSLSPGATKALVRIAEKLRDALA

SEQ ID NO: 303 - DNA, 810 bp, Unknown
  Obtained from environmental sample
atgacggcggagttcgcgacttcgctggcggacattccgacgacggagtatgaccaggagggtatccggggaagctggatcatgcccaatgatgcggattccgaacgcgtgcttttgtatcttcacggcggcggctacatagtcggaagcgatgaaacgccccgcgcgataaccgcatttctggcgcgcgaggcaaaagtgcggtgtttttccctggattatccgcttgcccccgagcatccatttccggctgcgctcgatagcgcggtgcgagcgtatgatatgctgttggaaaaggggttcagccctggaaacatcgtgctgggcggcgattcggccggcggcggcctggcgcttgccctgttgctcgccatccgggaacacgggctgccgatgccggcgggagcgtatctcctttccccgtggactgatttgacgcagagttttcccacgcattcacgcaaggccgatgtcgaaatcagcattacccccgagctgcttgaggaagcggcagccagctatgcgggtgattccgacagaaccaatccgcttatctcccccgcattcggcgagttccggggattcccgccgctcctgatacaagttggttcccatgaacgtctgttggacgactccctgacggtggcgcgcaatgccgccctcgccgatgtgccgacgacattgaaggtatggcccggctatccccatgtgtttcaagtctatcaccagaatctcgacggcgccaaaaaggcgttgagggaagccgcggaattcatcaccggagcgatggataaagagttgcttcaataa

SEQ ID NO: 304 - protein, 269 aa, Unknown
  Obtained from environmental sample
MTAEFATSLADIPTTEYDQEGIRGSWIMPNDADSERVLLYLHGGGYIVGSDETPRAITAFLAREAKVRCFSLDYPLAPEHPFPAALDSAVRAYDMLLEKGFSPGNIVLGGDSAGGGLALALLLAIREHGLPMPAGAYLLSPWTDLTQSFPTHSRKADVEISITPELLEEAAASYAGDSDRTNPLISPAFGEFRGFPPLLIQVGSHERLLDDSLTVARNAALADVPTTLKVWPGYPHVFQVYHQNLDGAKKALREAAEFITGAMDKELLQ

SEQ ID NO: 305 - DNA, 927 bp, Bacteria
ttgaaactcaaattcataacaacaatgcttttcgttttaagcaccttaccctttgcatctgccaacgccagtggttacacagaaaccaaataccccattgtcctcgttcatggactgtttggattcgataccctcgccggagttgattacttttatggcatcccacactctctgaccaaagatggtgcaacggtttatgtcgcgcaagtatctgcgaccaacagcagcgaggcacgtggagagcagcttcttgctcaagttgaaacactacttgccgcaacaggtgcagaaaaagtgaacttgattgggcatagccatggcggcccgacaacacgctacgttgcttcaatacgtcccgatttagtggcatccgttactagcattggtggtgtaaacaaaggctcaaaagtggcggacatcgtaagaaacaccgttccagaaggctccatcagtgaaggcgtagcagtaaagttggcagaagggctcgtaaccttgataaacctactgtctggtggttccgatcttgaccaagatccgcttgcttctttagccgcactcaccactgagggctcacttgagttcaaccaatattatcctgaaggtattccaaccagtgcatgtggagacggcgacttattggcatcgaatggcgtgtattactattcatggacaggctcttcgaactttaccaacctatttgacccaactgacggtgcaatggtggttttaggcttggcatttgatgggcccaacgacggtcttgtcgatgtatgtagcactcacctcggcaaagttattcgtgatgattacaagatgaatcatctggatgaaatcaacggactgcttggtatccaccacctcttcgagactgatccagtgacgttatatcgccagcatgctaatcgcctgaaactacagggtttataa

SEQ ID NO: 306 - protein, 308 aa, Bacteria
  SIGNAL (1)...(23)
  DOMAIN (42)...(299): alpha/beta hydrolase fold
MKLKFITTMLFVLSTLPFASANASGYTETKYPIVLVHGLFGFDTLAGVDYFYGIPHSLTKDGATVYVAQVSATNSSEARGEQLLAQVETLLAATGAEKVNLIGHSHGGPTTRYVASIRPDLVASVTSIGGVNKGSKVADIVRNTVPEGSISEGVAVKLAEGLVTLINLLSGGSDLDQDPLASLAALTTEGSLEFNQYYPEGIPTSACGDGDLLASNGVYYYSWTGSSNFTNLFDPTDGAMVVLGLAFDGPNDGLVDVCSTHLGKVIRDDYKMNHLDEINGLLGIHHLFETDPVTLYRQHANRLKLQGL

SEQ ID NO: 307 - DNA, 2040 bp, Unknown
  Obtained from environmental sample
atgcccaaaacctcgactaccgatccctggcgtgcgatccgcacccgggcgcagcgcacggtgcgcctgcttgcaggcggctccctgctatcactggctctcaccggcgcgcccgcactggccgcctacaccgggaacgcggctccctgcaataacggcaacccgcaagccggctcctggcaaggcgaggccacttacctgagcggtacctcgcgctatgactccggtgaatggatctataccgactatgtgttcgacgacggcgaactgctgaacaacgtcgccgacatcgtcgaattccgcgtctgccgggcggggaacgatctcaaggcgcgcgtcaccctcaactcgctgatggaaccggcgccggtggcgctggccgtggcagtggaatcggccaacggccgaagccggccctggccgcacaacgccggccttgaatcgaactggaaccagttcttcctggtaaccctggacgcagtcagcctcacccaagccaacggccgcacccagcagctgggtgcgcccgaggtggactacgagaacggcaccgtcagcttccgcctgccggccaccgcccgtggggcggccccggtgcggctggtggtcgccagcggcgagtggaccggcgaaggcttcggccagatggtcgacctggcgttcaacagccgtgaccgcgaagtgatgggcaccaacttccggtccatcgcccaaaatgccgccatcgccgacggcgacgtctccggcttctatgccgaggtggatctgctgaagctgcgccgccgggtaaccgacccgcaaatcaccgacagcggcttttacaaccgcatttaccgcagcgtgcaggacgtcgaaggcggctacgcctccagcttcccgaaataccaaggccgctggcagccctatggcctgtggattccaaaaggctacgacccggccgagccggctcccatgctgctgacgctgcacgccctgggatccacccacaacatgttcggcaccttcggcactttcccgaccatggccgatggcctgggcgcgattgccatcaccccgctggccatgggcaccgacggctggtactgggacgaagcgctggtggacaccttggacgcctgggccgacgccgaccgcgcctacaacattgatcgcgagcgggtgtactcctccggctactccatgggcggctacgcgacctatcgcctgaccacgctgttcccggacctgttcgccggggcggtgacctgggtcggcccgccggcgcaccagtactggctgccgccgttctcgccgtcaccggcgggtccgcgtcagcaggctggcaacaccagcacgatgatcgagaacgtcgcccatgtgccgttctacatcatcgccggcacgaccgacctgttggtcccggtcggcagcatcaacgcgcaggccaaccgtttcgcggcgctgggccatacctaccgctatgcgcttcacagcggcatgggccacttcgactacatcggctataacgactggacgcgcgagcgtgattggcttcagggccgtacccgcgtagtcaacccggcccaggtgtcgctgcgcattcggcccaacgcgctggccacctccaatctgccggagccgcgccggcaggcactgctcgatcacctcgccacgctaagcgcgcagctgggcggcgcggtggacggcgcttactggctgtcggggatcgccacctcggtgaccggcaaccagatcgcccaggtcgaactggtatccgccggtatcgccgagcgcaccccggtggttgagtcgttccagcgggcggaagccggtccgccgacgccgttcagcttgcgcggcgccgaccgcacctgggccgccgaaccggtagcgaacgcgctttccggccgactcgccggcgtcaccgagcttacggttgacctggcgcgggccgggctgttccgcaccggcctggacctgcagattacggttgatcagccggtcgcactgcaccttaaggaacgcgacggcagcatcgaaaccgtgcaactggcgccgtaa

SEQ ID NO: 308 - protein, 679 aa, Unknown
  Obtained from environmental sample
  SIGNAL (1)...(41)
MPKTSTTDPWRAIRTRAQRTVRLLAGGSLLSLALTGAPALAAYTGNAAPCNNGNPQAGSWQGEATYLSGTSRYDSGEWIYTDYVFDDGELLNNVADIVEFRVCRAGNDLKARVTLNSLMEPAPVALAVAVESANGRSRPWPHNAGLESNWNQFFLVTLDAVSLTQANGRTQQLGAPEVDYENGTVSFRLPATARGAAPVRLVVASGEWTGEGFGQMVDLAFNSRDREVMGTNFRSIAQNAAIADGDVSGFYAEVDLLKLRRRVTDPQITDSGFYNRIYRSVQDVEGGYASSFPKYQGRWQPYGLWIPKGYDPAEPAPMLLTLHALGSTHNMFGTFGTFPTMADGLGAIAITPLAMGTDGWYWDEALVDTLDAWADADRAYNIDRERVYSSGYSMGGYATYRLTTLFPDLFAGAVTWVGPPAHQYWLPPFSPSPAGPRQQAGNTSTMIENVAHVPFYIIAGTTDLLVPVGSINAQANRFAALGHTYRYALHSGMGHFDYIGYNDWTRERDWLQGRTRVVNPAQVSLRIRPNALATSNLPEPRRQALLDHLATLSAQLGGAVDGAYWLSGIATSVTGNQIAQVELVSAGIAERTPVVESFQRAEAGPPTPFSLRGADRTWAAEPVANALSGRLAGVTELTVDLARAGLFRTGLDLQITVDQPVALHLKERDGSIETVQLAP

SEQ ID NO: 309 - DNA, 1161 bp, Unknown
  Obtained from environmental sample
atggcgatgacaaacgaactgaacgagcaagtccaacacctgcttgacgagcgagtagcgtcaggtgaagagatcggcctccaggtcgcggtctacgtggatggcaggcaggtggtcgatacctgggccggggtggcggatgaggctaccggccgcaaggtggatggcgacaccctcttcacctcctggtccactacaaaagggtttgttgccacctgtgtccacatcctggcggactggggtctgctcgactatgacacaccggtggcaacctactggcccgaatttggcgccaatggcaaggaagccgtcaccgtacgccatgccaccacccacagcgccggcatcccgcagatgccagaaaatgtgacgccggagatgatgaccgactgggacgcgatgtgcgccgccattgccgcccacgaaccgctgtgggaacccggaacgaaaacgggttaccacgcctggacctttggctggattctgggcgagatcgtgcggcgggtcagtggccggtcgctggcgcagtttgcccaggaagagctgtgccgcccgctggggatcaccgatttctatctcggcatccccgatgcggcggagccgcgtgtggccccgctacgccaggacccgcaacatctggagaacaccctgagcgccggcgggttgaaccgccgcgttgcgcctcctcacgtgacaaccgccgcagtggtcaaccgacctgacttccgccgggcatcgatcccgggcggcggtggcatcatgaacgcccgcgccattgctcgccactatgccctgctggccggttttggcgcactggatggggtgcgcatcttgtcgccggagcgggtcgagatcatgcgcaccgtccagaccgacgccgaggacgtggtcatggggggactgactcgcaaagggctgggttattttctcggtggcgatgtggacaaaggagggcacgccgtcataggtcgtgccgagggcgcattcggccacgcgggcaacggtgggtcgattggctttgccgaccccgaacgcaaactggctttggggctgaccaagaactatatgcgggccgtgccggtaggccagccaagcacagcctatctggttgccgaactggtgcgtgcccatcttgacagccagcagacagtaacgccatga

SEQ ID NO: 310 - protein, 386 aa, Unknown
  Obtained from environmental sample
  DOMAIN (11)...(373): Beta-lactamase
MAMTNELNEQVQHLLDERVASGEEIGLQVAVYVDGRQVVDTWAGVADEATGRKVDGDTLFTSWSTTKGFVATCVHILADWGLLDYDTPVATYWPEFGANGKEAVTVRHATTHSAGIPQMPENVTPEMMTDWDAMCAAIAAHEPLWEPGTKTGYHAWTFGWILGEIVRRVSGRSLAQFAQEELCRPLGITDFYLGIPDAAEPRVAPLRQDPQHLENTLSAGGLNRRVAPPHVTTAAVVNRPDFRRASIPGGGGIMNARAIARHYALLAGFGALDGVRILSPERVEIMRTVQTDAEDVVMGGLTRKGLGYFLGGDVDKGGHAVIGRAEGAFGHAGNGGSIGFADPERKLALGLTKNYMRAVPVGQPSTAYLVAELVRAHLDSQQTVTP

SEQ ID NO: 311 - DNA, 1290 bp, Unknown
  Obtained from environmental sample
atgaaaaagatagtgatttattcatttgtagcaggggttatgacatcaggcggcgtatttgccgccagtgacaatattgtggagacgtcgaccccaccacagcatcaggccccaagcagacaggacagggcattattcgcgggtgatacaacaacctatataaaatgtgtctacaaagtggatggccaggatgacagcaatccatcctcatcttggttatgggcgaaagtgggtagcaactatgcgaagctgaaggggtattggtataattcaatgccgctggcaaacatgttttacactgaagtaccctatgcagaggtgatggacttgtgtaatagcaccctgaaggcggtaggtgccaactccactcttgttattccatatgcatcggattacaccctgtcctattactatgtgatttggaatcaaggggctaaccagccggttatcaacgttggcggcagagagcttgaccgtatggtggtctttggtgacagcttgagcgataccgtcaatgtctataacggctcgtacggtaccgtgccgaatagtacctcctggttattgggccatttctctaacggaaagctttggcatgaatacctttccacggtattgaatctgcctagctatgtgtgggcgactggcaatgcggagagtggagagaaacccttctttaacggattcagtaagcaggtggattctttcagggattatcacgctcgcactaaaggctacgatattagcaagacgttgtttaccgttctgtttggtggaaatgattttataacggggggaaaaagcgccgatgaggtcattgagcaatatacggtgtcattgaactacttggctcaactaggggcgaagcaggttgcaattttccgcttgccagatttttcagtgatacccagcgtttcaacgtggacagaggctgataaggacaaactgagagagaatagtgttcagtttaatgaccaagccgagaagctgatcgctaaactaaacgcggcacatccccaaacgacgttttatacgctgaggttggatgacgcttttaagcaggtgttggaaaacagcgaccaatacggctttgttaataagactgatacctgcctggatatttcccaaggcggatacaactatgccattggggcccgcgcgaaaacggcatgtaagagcagcaatgcggcgtttgtattctgggacaatatgcatccgaccaccaaaacacacggattgttggccgatcttttaaaagatgatgtggtacgcggcctcgctgcgccatga

SEQ ID NO: 312 - protein, 429 aa, Unknown
  Obtained from environmental sample
  SIGNAL (1)...(21)
  DOMAIN (160)...(418): GDSL-like Lipase/Acylhydrolase
MKKIVIYSFVAGVMTSGGVFAASDNIVETSTPPQHQAPSRQDRALFAGDTTTYIKCVYKVDGQDDSNPSSSWLWAKVGSNYAKLKGYWYNSMPLANMFYTEVPYAEVMDLCNSTLKAVGANSTLVIPYASDYTLSYYYVIWNQGANQPVINVGGRELDRMVVFGDSLSDTVNVYNGSYGTVPNSTSWLLGHFSNGKLWHEYLSTVLNLPSYVWATGNAESGEKPFFNGFSKQVDSFRDYHARTKGYDISKTLFTVLFGGNDFITGGKSADEVIEQYTVSLNYLAQLGAKQVAIFRLPDFSVIPSVSTWTEADKDKLRENSVQFNDQAEKLIAKLNAAHPQTTFYTLRLDDAFKQVLENSDQYGFVNKTDTCLDISQGGYNYAIGARAKTACKSSNAAFVFWDNMHPTTKTHGLLADLLKDDVVRGLAAP

SEQ ID NO: 313 - DNA, 987 bp, Unknown
  Obtained from environmental sample
atgccccgcccccgcgtgatcgcaggcgctgcagcgctggccgccatcgccggggcggccctgtggtggttcgccaccccctttgaaactggtgctggaacaggggcatacagcctgggtgcagcgccctccatcgcagccgccgccggggccggcgcgtcgccggggcagccccggaacggcagtttctcccatccagcaaggtgggggcccgaagcggacaactccgaccccttgctggtgcagggcttgcgcgacacgcttgaagccatgctgctggaagccggggatgcgggcgacccggcggccctcaagcaaaggctggcggcgctggtgggccagcacttcccagcagcgtttgccgcccgggcgctggccctggccgagcgctatgtggactaccgcgtcgcactgggcgggctgcgcgcgccgcaggacccgaccgatccccgtgcgctgcgcgacgcgctggaagcgcgccacaaggtgcgcgcacaatttttcgacggcgccgagtacgacgccctcttcgcccgcgaggccgaactggaccgctacaccctcgcgcgcctggagatcacccgcaacaccgcgctcacccccgagcagcgggcccaggccctgcaggctgcggaccaggagctttccagcgagcgccgcgcggaacgagccgcagcgaccgagcacctggctgcagccgcccagaccgcagccttcaacgcacagaacgcgagcgactacacgcgccacaccgcgcgcagcgcgcaatacggcgaggcggcggcccacgcgctggcccggctggaccgcgaagagcagcattggcagcaaaggctcgaccagtacagccaggcccgagcccagcaaggcgacaacagtgccgcgctgcagcaactgcgccagcagctcttttccagcgaggagcagcagcgcgtcgacgccgccctggcgctgcgcaagctcggccccgctcccgcgggctcctga

SEQ ID NO: 314 - protein, 328 aa, Unknown
  Obtained from environmental sample
  DOMAIN (42)...(321): Proteobacterial lipase chaperone protein
MPRPRVIAGAAALAAIAGAALWWFATPFETGAGTGAYSLGAAPSIAAAAGAGASPGQPRNGSFSHPARWGPEADNSDPLLVQGLRDTLEAMLLEAGDAGDPAALKQRLAALVGQHFPAAFAARALALAERYVDYRVALGGLRAPQDPTDPRALRDALEARHKVRAQFFDGAEYDALFAREAELDRYTLARLEITRNTALTPEQRAQALQAADQELSSERRAERAAATEHLAAAAQTAAFNAQNASDYTRHTARSAQYGEAAAHALARLDREEQHWQQRLDQYSQARAQQGDNSAALQQLRQQLFSSEEQQRVDAALALRKLGPAPAGS

SEQ ID NO: 315 - DNA, 771 bp, Unknown
  Obtained from environmental sample
atgaaaaaacttggacttgcattgggcggcggcgctgtgttgggggctgcccatatcggtgttctggaagccctggaggaaaggggtatcaggcccgaatatatcagcggaaccagcattggcgcttttgtcggtgctctctatgctttcggcaagacggcagccgagctcaaagaaatcgccctggaattggactggctcgatgtcaccaattttaaattgtcgaaaatggggttgttggggaatgacaggatcggtaaactgattcttgataacctgggaaaacaacagattgaagattctcaaatcaaactcgctattgtaacaacggatatctcaaatggggaaaaagtggtgctgaccgagggtccgctcttcaaggctgttatggccagttcttgcctgccgggcatatttattccggttgaatggggggatcgcctcctggttgacggggtcttaagcgaaaatgtgccggtatcacctctccgggatatgggggcagaagatattattgccgttgaccttacaacaaacagggactttaaacgtcccaatgatatcattgatgtactgtccaatacgtttgctattggcctcaataaaattgttatcgaacaactcgacgatacgcgaaccatcatgattcaaccgaaactgagcgcatacaacaaagcggatacccgaaaaatgaaggcgttgatcaaagaagggtatgaggagacatgccggattttggatcagcagcagctgaactccctgaaacactga

SEQ ID NO: 316 - protein, 256 aa, Unknown
  Obtained from environmental sample
  SIGNAL (1)...(24)
  DOMAIN (6)...(164): Patatin-like phospholipase
MKKLGLALGGGAVLGAAHIGVLEALEERGIRPEYISGTSIGAFVGALYAFGKTAAELKEIALELDWLDVTNFKLSKMGLLGNDRIGKLILDNLGKQQIEDSQIKLAIVTTDISNGEKVVLTEGPLFKAVMASSCLPGIFIPVEWGDRLLVDGVLSENVPVSPLRDMGAEDIIAVDLTTNRDFKRPNDIIDVLSNTFAIGLNKIVIEQLDDTRTIMIQPKLSAYNKADTRKMKALIKEGYEETCRILDQQQLNSLKH

SEQ ID NO: 317 - DNA, 786 bp, Unknown
  Obtained from environmental sample
gtgctcccctccgacgccggcaagtacaagtacctcgtcatcggcgggctcttcggcaagcacctgcctggctacatggacgagaacgtgaacgcgctgaagtcccaggggctggacgcgcgccaggtgccggtggactccgacgcctcggtgaagacgaacgccgagaccatccgcaaggccatcgaggaggcgacgaaggacggcagccaggtggtgctggtcggccacagcaagggcggcgtggacgcggcggcggcgctcgcgatgcacccggagctgaaggacaaggtccgcgccatggtcgccatccagtcgcccttcggcggctcgcccatcgcgcaggacatcgagtccacgcccatcatccggccgctggtgaacggcgtggtgggcgagctgttccgcggcgacccggcgagcgtgaaggacctcacctatgacgcgcgcgagaagttcctcgccaggtacccgctgcctgcggacgtgccctcggtgtgcgtggcgacctcgcggctgtcgccgacgtcgatcctcggcagctccgagggctacctcaaggcgcgctacgggttcccgtcggacgggctggtgaacccggcggacgccgtcatccccggctcgcacgtggtgcggctcaacgacatggaccacgcggagtccaccctccacgggctgcccggcttctccaactactacccgaaggacgtcaccctggcctcggtggcgctggcgctggacgccgcgcgcgagcaggacggggcgaagcacagcgaggcgttctag

SEQ ID NO: 318 - protein, 261 aa, Unknown
  Obtained from environmental sample
MLPSDAGKYKYLVIGGLFGKHLPGYMDENVNALKSQGLDARQVPVDSDASVKTNAETIRKAIEEATKDGSQVVLVGHSKGGVDAAAALAMHPELKDKVRAMVAIQSPFGGSPIAQDIESTPIIRPLVNGVVGELFRGDPASVKDLTYDAREKFLARYPLPADVPSVCVATSRLSPTSILGSSEGYLKARYGFPSDGLVNPADAVIPGSHVVRLNDMDHAESTLHGLPGFSNYYPKDVTLASVALALDAAREQDGAKHSEAF

SEQ ID NO: 319 - DNA, 942 bp, Unknown
  Obtained from environmental sample
atgaccggattctttggccgcgttctgcggcaattcgctctggccgcggccgctgcatggctgctcgtcggcgccagcgcccaggcccagacgggcgccacccagacgcgctatcccatcgtgctggtgcacggccttttcggctttgactcggccctgggtgtcgactacttctatggcatcccggacgccctgcgccagggcggcgcgaaggtctacgtggcacaggtctccgcagccaacagcaccgaggtgcggggcgagcagctgcttgcgcaggtgaacaccatcctcgccatcacgggtgccgccaaggtcaacctggtgggccactcgcacggcggccccaccgcgcgctacgtggccggcgtggcgccgggcaaggtcgcttcggtgacctcggtcggcggcgtcaaccgcggctcgcgggtggccgacatcatgcgcggcgtggcgcccgcgggctcggtgtccgaaaccatcgccagcggcgcggcatcggcgctggtcgcgctgatcaacctgacctcggggggctcgggcctgccgcagatgcccacggcggcgctcgactccctcaccacggccggcgccgccagcttcaaccgccgctttccccaaggcgtgcccacctccggctgcggcagcggcgccgaactcgtcaacggcgtgcgctactactcctggacgggcaccaagaccctgaccaatgtgctggacgccagcgatgccctgctgggcgtgctcggcctggtgttcggcgaagccaacgacgggctggtgtcggcctgctcgtcccgcctgggcaagcacctgggcgactaccgacagaaccatctggacgaggtgaaccagctggtcggcctgcgtgactggttttccaccgaccccgtgacgctgtaccgccagcacgccagccgcctgaagtcgcagggcctgtga

SEQ ID NO: 320 - protein, 313 aa, Unknown
  Obtained from environmental sample
  SIGNAL (1)...(29)
  DOMAIN (49)...(291): alpha/beta hydrolase fold
MTGFFGRVLRQFALAAAAAWLLVGASAQAQTGATQTRYPIVLVHGLFGFDSALGVDYFYGIPDALRQGGAKVYVAQVSAANSTEVRGEQLLAQVNTILAITGAAKVNLVGHSHGGPTARYVAGVAPGKVASVTSVGGVNRGSRVADIMRGVAPAGSVSETIASGAASALVALINLTSGGSGLPQMPTAALDSLTTAGAASFNRRFPQGVPTSGCGSGAELVNGVRYYSWTGTKTLTNVLDASDALLGVLGLVFGEANDGLVSACSSRLGKHLGDYRQNHLDEVNQLVGLRDWFSTDPVTLYRQHASRLKSQGL

SEQ ID NO: 321 - DNA, 672 bp, Unknown
  Obtained from environmental sample
atgaataaagtagttacactcattctgattatttgcctggcagcagcctgcagcaatgatcagaagaaaaacaatacgacagaagagaacaagatgcccgttcagaaagaaattaaaaacatcctttttttcggtaatagccttacagcagggtacggactcgacgatccctcagctcaatcattccccgcattgattcaaaataaaatagattctttaggtcttccttacagatgtattaatgcgggttcaagcggcgaaaccactgcaggaggcaaaagccgcatcggctggctcctgcgaaacaaggttgatgtatttgtccttgaactgggcgcgaacgacggactgcggggaataccggtaaaagaaacaaaagcaaaccttcaggcgattgtggatacagtcaggtcaaaatatccttcggctaagcttgtcctcctcggtatggaggtcccgcccaatatgggaggaagttatgccgccagcttccgtgtcattttcagggagatagcagaaaaaaacaatatgacattcgttcctttcctgcttgataacgtagccggaatcagcaggctgaaccaaaaagacggcatccacccaacaatggaaggggttcgaattatgactgaaaacgtgtggaaagagttaaagaaagttttgtcagattaa

SEQ ID NO: 322 - protein, 223 aa, Unknown
  Obtained from environmental sample
  DOMAIN (41)...(213): GDSL-like Lipase/Acylhydrolase
MNKVVTLILIICLAAACSNDQKKNNTTEENKMPVQKEIKNILFFGNSLTAGYGLDDPSAQSFPALIQNKIDSLGLPYRCINAGSSGETTAGGKSRIGWLLRNKVDVFVLELGANDGLRGIPVKETKANLQAIVDTVRSKYPSAKLVLLGMEVPPNMGGSYAASFRVIFREIAEKNNMTFVPFLLDNVAGISRLNQKDGIHPTMEGVRIMTENVWKELKKVLSD

SEQ ID NO: 323 - DNA, 660 bp, Unknown
  Obtained from environmental sample
gtgccagacctaagtaacacctccctgctgcaattcaacggctggacgctgcgggttcggcaagcggctgccagacctgcccgtctgctgctcatgctgcacggttacaccggcgacgaaaactccatgtgggtgtttgcgaaggacatgccgcctcattactggattgccgccccgcgcgcgcctttccccgccgagccgagaggctattcctggcgtccgcttcacccggcgacctttggccgccccagtctcgaagaacttgtgcctcaggctgaggcgttgattcgctttgtggacgagtaccaggcttcggcggggatcgaagcgtccgatttcgatgtgatgggattcagccagggcggagcgatgtccaacgtgctggcgttcctgtatccgcagcgcatccgcaaattggggatgctggcggggtttgtccccggcgggttggatgtgtatgccaaaaatcatccgcttcaagggaagcgggtgttcgtcacgcatggcacgcgcgatgacatggtgccgattgaccgcgcccgcgcctcggttgccgtgctggagcaggcaggcgcgcagattgtttattgtgaggatgaggttggtcacaaagtcagcctcaattgcctgcgcgcgctgcgctcgtatctggaagattag

SEQ ID NO: 324 - protein, 219 aa, Unknown
  Obtained from environmental sample
  DOMAIN (17)...(218): Phospholipase/Carboxylesterase
MPDLSNTSLLQFNGWTLRVRQAAARPARLLLMLHGYTGDENSMWVFAKDMPPHYWIAAPRAPFPAEPRGYSWRPLHPATFGRPSLEELVPQAEALIRFVDEYQASAGIEASDFDVMGFSQGGAMSNVLAFLYPQRIRKLGMLAGFVPGGLDVYAKNHPLQGKRVFVTHGTRDDMVPIDRARASVAVLEQAGAQIVYCEDEVGHKVSLNCLRALRSYLED

SEQ ID NO: 325 - DNA, 672 bp, Unknown
  Obtained from environmental sample
atgagaagaattgttttcctttatattctggcgttgctctgcgtatcctgtgcgaaccggaatccttctgtctcggaccccgctccgtcaccgaccttgggggagcaatcgtcagcgagtttaccgaagatcgtagcattcggcgacagcctaactgctggctttggtctttcccagaatgaaagttatccagcgcttttgcaggaacgactgagacaggacggttatgattacgaagtgatcaatgccggagtttcaggcgataccagcgcgggcggtgtgcgtaggatcgactgggttctggatgagagcgtacgaattctaattcttgaattgggtgctaatgattttcttcgtggccatccagtagctcagactaagaaaaacctcgccgttatcatcgaacgtgctcaggaaaaaaacgtcagggttctgctagcagggatgtttgcaccgacgaatactggatgggagtaccaggggcagatccagcaaatgtttaacgatctttcgcgagaaaaagccgtaccactaattccattctttctcgagggagtagccggcattccaactctgaatctagctgatggcattcatcccaatgcggctggcacaaagatcgttgctgagaatgtgtacaagtatctaaaaccgatgctcccatctgattaa

SEQ ID NO: 326 - protein, 223 aa, Unknown
  Obtained from environmental sample
  SIGNAL (1)...(25)
  DOMAIN (44)...(212): GDSL-like Lipase/Acylhydrolase
MRRIVFLYILALLCVSCANRNPSVSDPAPSPTLGEQSSASLPKIVAFGDSLTAGFGLSQNESYPALLQERLRQDGYDYEVINAGVSGDTSAGGVRRIDWVLDESVRILILELGANDFLRGHPVAQTKKNLAVIIERAQEKNVRVLLAGMFAPTNTGWEYQGQIQQMFNDLSREKAVPLIPFFLEGVAGIPTLNLADGIHPNAAGTKIVAENVYKYLKPMLPSD

SEQ ID NO: 327 - DNA, 1329 bp, Unknown
  Obtained from environmental sample
atgagcctcaacagccaagactacgctgcgctatccgaagatgcatacaaggattatgcggtcggtcgtcgagcgcctggtcaagaagaaatcgttccgatcaacgggcacaagtacaagatcctcgagcacgttgacaatcggctgaacggttatcagggaacgatctaccagcgagtcgacaccaatgaaattgtcgtcgcacatcgcggaaccgaacaaatcgcacgcgatgcgattctgaccgatggtggcatggtcgttgcccgtaccaatgtgcaggcgccagacgcaatcgcgctgacccaacgcgccctggcttacgccaagaaggaggggcaggatctcggccaacgtccgcctgaggtcaccgtcaccggccactccctcggcggcgctctggcccagatcacctcgcaccacttcaacgtcaagggcgagaccttcaacgcctatggcgcggtcagcctcagctaccgcatcccggaaggtggcaacaccatgatcaaccatgtcatggcctccgatccggtcagcgcggcgtcgccacatttcggccaggtgcggatctacgccaggccgaatgaaatcagcacgctcgccgcgaacggtttcagcaatcactcgttgcgcgcccttatccccgaccggccgatcatcgccgcaggcagctcgttcggcgcgcacaagctgggcaacttcctcggtgacggctcggtgctgcagcacccggaaacgcagaagctggcaaaagacaacgccaggatgatcgaggaataccgcgacgacgttgaattactgcgccgtggtgtcacccgcgcggcgcggggcattccgggcggcgccgtcgacctgtacgaccacatccgcggcccgctgcagcccggtgagccggcacgccgcgaagcggagaagaacggccatcacaccagcatgctgcgaatggacgatgccaaccatgtgggcaacccactgttcaacgacgcgatccgtggcgtgcacgcgcaggatgtccgcgtcggccgggtaccagacgtgatgagcacgcaactggcaggcagtctggccgccgaaatgcacgcagcaggcggcaagcgcatcgacgaagtggtcatgaatgccgatgcctcgcgcagcttcgccgtgcagggccagggcggtgaccccgcccaccttcgtgtgtcggtggatacggcagtggcgatgaacaccccgctggaacagagcagccagcgcatcgaccagcaggccgccgaccagcgcgttgcgctggagcgcgaccagcagctggaacagcagcggaaccagacccgcagcctgcaggcctga

SEQ ID NO: 328 - protein, 442 aa, Unknown
  Obtained from environmental sample
  DOMAIN (62)...(186): Lipase (class 3)
MSLNSQDYAALSEDAYKDYAVGRRAPGQEEIVPINGHKYKILEHVDNRLNGYQGTIYQRVDTNEIVVAHRGTEQIARDAILTDGGMVVARTNVQAPDAIALTQRALAYAKKEGQDLGQRPPEVTVTGHSLGGALAQITSHHFNVKGETFNAYGAVSLSYRIPEGGNTMINHVMASDPVSAASPHFGQVRIYARPNEISTLAANGFSNHSLRALIPDRPIIAAGSSFGAHKLGNFLGDGSVLQHPETQKLAKDNARMIEEYRDDVELLRRGVTRAARGIPGGAVDLYDHIRGPLQPGEPARREAEKNGHHTSMLRMDDANHVGNPLFNDAIRGVHAQDVRVGRVPDVMSTQLAGSLAAEMHAAGGKRIDEVVMNADASRSFAVQGQGGDPAHLRVSVDTAVAMNTPLEQSSQRIDQQAADQRVALERDQQLEQQRNQTRSLQA

SEQ ID NO: 329 - DNA, 1224 bp, Unknown
  Obtained from environmental sample
atgcgcattacggtcagaaaatttgttgccctgagtcttctgctttcgctggcgctcgtagcgcgtgcgcagacggtcagtccagaatcagtcggtttatcgtcagaacggctgcagcgcatcaacgacctcgtgcaggaaaatatggatgcaggccgcattaccggtgccgttacgctcgttgctcgtcatggcaagattgcacacctcgaagcgcagggagtgatggatattgcatccggaaaaccgatgaaaaccgacacgatctttcgcctggcgtcgatgtcgaaaccggtcgccggccttgcgatcatgatgctggtcgaggagggcaaggttggcctcaacgataatgtgtcggactatctgccgagtttcaaagcgcagcaggttgcggtacgcaagggagatggcgcagacaatttcgagcttgtgcctgccgagcgcgaaattacgatcaaggatttgctgacacatacttcaggcgtaatgagcggacagataagcagcaatgcgggcaatcccttgttcgtaacacgtcatgacatcggcctcgcctgggtcgatgaactcggcaaggcaccgctcgagtttcagcccggctcgcgctgggcctacagtgcgacggcaggtttcgacgtgctgagccgcattgtcgagcttgcttccgggcagacgttcaacgatttcttgcaagagcgcgtatttgctccgctcgatatggacgatatttttttctggcccaatgccgatcagcgtgaacgcattgtgagctcatacgtattgaacgagggcaagctggtgttacgcgacaaccccgattcgatgtcgggagaaaagtttttttcgggcgccggcggcctcatggcttccgccgaagcgtatgcgcagtttgcaatgctgctggcgcaaggcggtgaacttgatggcacacgtttgctcggcactcgtacgatggaagtgatgcgcgcgccattcatccctgactcgttgccgggccgcacgccgggcgaaggttatggcctcggcgtgcgcgtggtgaccgatccgatcaagatggcaagtttcgtatccgagggcacgttcggctggtcaggattttacggcacgcatttgtttgtcgaccccaaagaagaaattgtcggcatcctgctgatccagtccccgattggagcgatgcggcccgaatttgaaacagcggtgatgcaggctgtcatcgactga

SEQ ID NO: 330 - protein, 407 aa, Unknown
  Obtained from environmental sample
  SIGNAL (1)...(23)
  DOMAIN (41)...(407): Beta-lactamase
MRITVRKFVALSLLLSLALVARAQTVSPESVGLSSERLQRINDLVQENMDAGRITGAVTLVARHGKIAHLEAQGVMDIASGKPMKTDTIFRLASMSKPVAGLAIMMLVEEGKVGLNDNVSDYLPSFKAQQVAVRKGDGADNFELVPAEREITIKDLLTHTSGVMSGQISSNAGNPLFVTRHDIGLAWVDELGKAPLEFQPGSRWAYSATAGFDVLSRIVELASGQTFNDFLQERVFAPLDMDDIFFWPNADQRERIVSSYVLNEGKLVLRDNPDSMSGEKFFSGAGGLMASAEAYAQFAMLLAQGGELDGTRLLGTRTMEVMRAPFIPDSLPGRTPGEGYGLGVRVVTDPIKMASFVSEGTFGWSGFYGTHLFVDPKEEIVGILLIQSPIGAMRPEFETAVMQAVID

SEQ ID NO: 331 - DNA, 1245 bp, Unknown
  Obtained from environmental sample
atgttctggttggcacttatctgggccctgctggccctgaatctgtattacccctggaagggcaaacccgaggtcggtggcgtgatcagcttcgccttcgggctgttggtgggcgaactcgccttgcatgtgattgcactgcaagtcctcactaccctgctgtttatcaccttctgcggcctctcgggcttcggcgatgcgttgggcctgatgctcgccatggccacctggctggcgatggcctggttctacgcacgcagcgagcgcgcggggccggcgatggagaacggcattcgccaggccctgggcgaagactattcaaaactgatttcggccgagcgcagcgactgcctgcaccgcgacatagattaccggcagctgcttaacccctttgccttcagcaaacccgaagtgacccgacaccgcaatctgccctacgcggaagtggacggcaaaaaccttcatctggatatcttccaccaccgcgacaagccacaaaacgcgccagtactgctgcaaattcacggcggcgcctggctgcagaatctgggcaacaaggatcagcaggcactgccgctgatgaatgaactggccagccgcggctgggtttgcgtaacagtgcaataccggctgagccccggcgtcgccatgcccacccatattattgactgcaagcgcgcactggtctgggcgaaggagcatatcgccgattacggtggcgatccgaacttcattatcgtcaccggcggttccgctggcggccatctgtcagcgatggtggcgctcaccgccaaccaacccgaattccagccgggtttcgaggacacggatacccgcgtacaaggtgccgtacctttctacggtatccacgactttaccaacagccgtggtcagcgcgagcataaggggctggagaacttcatcgcgcaacgcgtaatgaaagtgacccgctacgataaccccaaactgtgggagcaatgctctcccctgtttcaggtaaaagacgacgcgcctccaatgctgttggtacacggcgaggccgataccctggcaccgatcagcgaatcgcaggccttgctggaggttttgcgggaacacgacgtcaaagcgggtctggcggcactccccgatgcgcagcacgccttcgaactgatgtactcgctgcgcaccctgtatatgattaacgccgtggagcgcttcggcaacgcgctgcacggcaagtatctacaggatggcgcagcttaa

SEQ ID NO: 332 - protein, 414 aa, Unknown
  Obtained from environmental sample
MFWLALIWALLALNLYYPWKGKPEVGGVISFAFGLLVGELALHVIALQVLTTLLFITFCGLSGFGDALGLMLAMATWLAMAWFYARSERAGPAMENGIRQALGEDYSKLISAERSDCLHRDIDYRQLLNPFAFSKPEVTRHRNLPYAEVDGKNLHLDIFHHRDKPQNAPVLLQIHGGAWLQNLGNKDQQALPLMNELASRGWVCVTVQYRLSPGVAMPTHIIDCKRALVWAKEHIADYGGDPNFIIVTGGSAGGHLSAMVALTANQPEFQPGFEDTDTRVQGAVPFYGIHDFTNSRGQREHKGLENFIAQRVMKVTRYDNPKLWEQCSPLFQVKDDAPPMLLVHGEADTLAPISESQALLEVLREHDVKAGLAALPDAQHAFELMYSLRTLYMINAVERFGNALHGKYLQDGAA

SEQ ID NO: 333 - DNA, 1104 bp, Unknown
  Obtained from environmental sample
atgcaagtcaatggtgcaattgcagttactgatccggcgttgagcaatgcagtggaagcaacctcttaccagacatctgaacagattgtgggtggagtaagcgaagcggcggaagcagggttggcggcagaagtgggcgcggcggagacgttcgctgcagctgacgatgttgccctttcatccatggtcgccggcccggctaatgatgcctcttacggcaacctgcccgcagggtgggatgaggcccggtttgatcatgccctggatatggccaagttgtcctctcaggcctacagcagtttcaatgacagaactgtagatcttctactggcgccgtttagcggtatcaatgacataaaaaatcaagatttctccaccgataattatctccctataaattccggtggcaaatctgacttcctgttgcccctgcagaatgggctggactatacggtcttccagcaagtcaccgatcctaatggtgtcgatcatgccgccaagactgccggcggcgatatcgttctttccttccggggcagtgaacccacatccgccccggattgggtgaacaatgtgaagcaggccgctggccattctccccaatatggggccgcggtaaatgtggcgagggatttgcagcagcaagtggatgcctataatgagaagcatgggcttgaaggcgacgctgccatgaagctccacttcaccggccacagcctgggtggcggattggccactgccgctgccctggctaccggtagcgaagcgacagtctttaatgctgccggtctctcagaccataccattaacaaccttggcctggacgcaagccatgccgacaaggtgaccaatattaacgtggaaggcgatctgctgagcgatggcaaccggcagaaggatgctcacaccacgggctctggtgtctttggcgataccaagcaatatggtgagcaggtctggctgcagggtgtagatgaccgcgcaagatttggcggccctctcaacttcctggtgccgggctttgtcaacgacctggccattcaggggcttaatcacgcctggcatgtgtatacctaccaattggaaaaccgcaactttgcctga

SEQ ID NO: 334 - protein, 367 aa, Unknown
  Obtained from environmental sample
MQVNGAIAVTDPALSNAVEATSYQTSEQIVGGVSEAAEAGLAAEVGAAETFAAADDVALSSMVAGPANDASYGNLPAGWDEARFDHALDMAKLSSQAYSSFNDRTVDLLLAPFSGINDIKNQDFSTDNYLPINSGGKSDFLLPLQNGLDYTVFQQVTDPNGVDHAAKTAGGDIVLSFRGSEPTSAPDWVNNVKQAAGHSPQYGAAVNVARDLQQQVDAYNEKHGLEGDAAMKLHFTGHSLGGGLATAAALATGSEATVFNAAGLSDHTINNLGLDASHADKVTNINVEGDLLSDGNRQKDAHTTGSGVFGDTKQYGEQVWLQGVDDRARFGGPLNFLVPGFVNDLAIQGLNHAWHVYTYQLENRNFA

SEQ ID NO: 335 - DNA, 1137 bp, Unknown
  Obtained from environmental sample
atggcccgcaagttcctctatcttatcgccctgcttgccgtgatggtcattgcagcgatcttcgcgctgcgcatctggcagaacgagctcacccgcttcgcattcgtaccgcgcgtggcttacgcccgcctcgatccgctgcctgcagatgcctatgccggcaaccggatgtggctcgcccgcccggggctcggtgatagcgatcccgcacagtggctccctgcaggagtaaggaagagtgccggtccgggcacatctgccgcagtgttcttcattcatccgaccagctatctcgcgcgcgaaagctggaacggtccgctcgacgataccgatacgaatcgccgggccacctatttcatccaaggtatggcctctgccttcaacgggcaggcacaggtctgggcaccgcgctatcggcaagccgccttcggcgcattcctcaccgacaaggccgagggcgagctggccctggactctgcctacctcgatgtccggcaggccttcgacgccttccttgcggcgacaccgcccgatgcaccgatcgtgctggcagggcacagccagggcgcgctccacctgatgcgcctcttgaaggaccggattgccggaacaccactcgctggccgggtggtagcggcctacccgatcggatggccgatctcggtcgagcatgatcttcccccgcttggccttccggcttgcgacaagagcgatgctactggctgcatcatgacgtggtcgagtttcgctgagcccgccgaaccgcaacttgtgttggaagcgtaccgcacgcgccccgcgcttgatgggaaagccaaggatgcaaagccggttctgtgcaccaacccgcttactggaagcatcggcggacaggcacccgcgtcggccaaccttggcacgctaaagcccagcaaggacctgaagagtggtgagttgatcgccaaggctgttccggcccgctgcgataccagcaccggcttgctgatgatcggggacccaccggaccttgggccgtttgtcctgccaggcaacaactaccacgtctatgacatccccctgttctgggcgaacctgcgcgcagatgtcggccggcggaccgcaacgtgggagaaggcacgcggagcggccgcccggtga

SEQ ID NO: 336 - protein, 378 aa, Unknown
  Obtained from environmental sample
MARKFLYLIALLAVMVIAAIFALRIWQNELTRFAFVPRVAYARLDPLPADAYAGNRMWLARPGLGDSDPAQWLPAGVRKSAGPGTSAAVFFIHPTSYLARESWNGPLDDTDTNRRATYFIQGMASAFNGQAQVWAPRYRQAAFGAFLTDKAEGELALDSAYLDVRQAFDAFLAATPPDAPIVLAGHSQGALHLMRLLKDRIAGTPLAGRVVAAYPIGWPISVEHDLPPLGLPACDKSDATGCIMTWSSFAEPAEPQLVLEAYRTRPALDGKAKDAKPVLCTNPLTGSIGGQAPASANLGTLKPSKDLKSGELIAKAVPARCDTSTGLLMIGDPPDLGPFVLPGNNYHVYDIPLFWANLRADVGRRTATWEKARGAAAR

SEQ ID NO: 337 - DNA, 1104 bp, Unknown
  Obtained from environmental sample
atgcaagtcagtggtgcaatggaagcaataaatcctgcgcagatgaatgcagcggaagtcacttcatcgcaggtatctgaccagatcatcggcggcgttagccaggtgccggaagcaggtttagctagtgaagtcggagcaatggcgatggcacctgctgctgaagatgcggcccttgccgccatggttgccggccctgccaatcaagccagttacggcaatttgcccagtgactggacggaagccgactataatcatgctctcgacatggccaagctgtcttcccaagcttatagccggttcaacgatatcaccgtcgatcttctgttggctccatttggtggtattggtgacataaaagcgcaggattttaccaccgataactggcgcctaatggacaccagtggcaagagtgactttttcttacccgtacagagcgggctggacttcactgtttttgaggcggtagccgatgacccggcagctaatgtgaaggaaggggatattgtgctcgcatttcgcggcagtgagcctacctccgcaccggattggatcaataatgtaaaacaggcggcgggtaattcctctcagtatgctcaggcggtagaagtcgcgaaggagctgcaagggcaggtagaccagtacaatgcagacaataacctgaccggcaatgatgccagaagcctccattttaccggccatagcctgggcgggggattggcaacagcggccgcgctggccacaggcagtagcgctaccgccttcaatgcagcgggccttggggattccaccctaaagaaccttgggctcaatgaagggctggcggcaggcttccacaataacgttaccaatattaatgtggaaggcgatctgttgagcgatgccaaccgccaaaaggatgtctataccacgggttcaggcatcctcgatgaaaccaggcagtatggggaacaggtttggctgcagggcgtcgatgataaggccagattgggcggaccgcttaatcccctgataccgggagtggctgatgacctggcaatccaggcactcaaccatgcctggcatgtgtatacctaccagttggaaaatcgcaacttcgcctaa

SEQ ID NO: 338 - protein, 367 aa, Unknown
  Obtained from environmental sample
MQVSGAMEAINPAQMNAAEVTSSQVSDQIIGGVSQVPEAGLASEVGAMAMAPAAEDAALAAMVAGPANQASYGNLPSDWTEADYNHALDMAKLSSQAYSRFNDITVDLLLAPFGGIGDIKAQDFTTDNWRLMDTSGKSDFFLPVQSGLDFTVFEAVADDPAANVKEGDIVLAFRGSEPTSAPDWINNVKQAAGNSSQYAQAVEVAKELQGQVDQYNADNNLTGNDARSLHFTGHSLGGGLATAAALATGSSATAFNAAGLGDSTLKNLGLNEGLAAGFHNNVTNINVEGDLLSDANRQKDVYTTGSGILDETRQYGEQVWLQGVDDKARLGGPLNPLIPGVADDLAIQALNHAWHVYTYQLENRNFA

SEQ ID NO: 339 - DNA, 1245 bp, Unknown; identical to SEQ ID NO: 7
  Obtained from environmental sample

SEQ ID NO: 340 - protein, 414 aa, Unknown; identical to SEQ ID NO: 8
  Obtained from environmental sample
  SIGNAL (1)...(30)

SEQ ID NO: 341 - DNA, 843 bp, Unknown
  Obtained from environmental sample
gtgcgtgaagggctggcctatctgaccgcgtcactggtcacgagcaagccaacactgccctggataggggatgcgatggtgccaggtggtgaatacaccgtaccggtacgtatctacgaccctgacccgacacaggccaaacctgtctgtctgtatctgcatggaggtgggcatctggctggcagcgtcagtgtctatgaccccatctgccgtaaactggccgcagccagcgggcagctggtcgtatctgtcgaatatcgtctggcacctgagtgtccctacccctgtgcactacaggatgccatcagtgttgtcagacatatccagccggtactgcaagagaagcagcgtctcatcacagatcaactcaatatcgctggcgattccggtggcggtgcactggccgcgtctgtctgtgccgccctgcaatccgaacagccacacccgatcaaccgtcagttgctgatctatcccaatctggattacacgctggagcatccatcggttgagcaactgagtgaaggctatctgctcgagaaagcccgtatcctctggtactacgagcagtattttcagcacaacgaggatcgtgtcgccgcctcccctctgcatatgcccatgaccgcacaactgccacccaccttcatcatcaccgccggttattgcccgttaaaggatgaggcagcagtttatctccaacgccttgatgcattgggggttcacactgggcatctggcgtttgataacctgctgcatgcctttctgaatatggaggatctggtaccggatgcctgtgcccaaagctatcaggcgatggctggattccttaaccgatcattctag

SEQ ID NO: 342 - protein, 280 aa, Unknown
  Obtained from environmental sample
MREGLAYLTASLVTSKPTLPWIGDAMVPGGEYTVPVRIYDPDPTQAKPVCLYLHGGGHLAGSVSVYDPICRKLAAASGQLVVSVEYRLAPECPYPCALQDAISVVRHIQPVLQEKQRLITDQLNIAGDSGGGALAASVCAALQSEQPHPINRQLLIYPNLDYTLEHPSVEQLSEGYLLEKARILWYYEQYFQHNEDRVAASPLHMPMTAQLPPTFIITAGYCPLKDEAAVYLQRLDALGVHTGHLAFDNLLHAFLNMEDLVPDACAQSYQAMAGFLNRSF

SEQ ID NO: 343 - DNA, 981 bp, Unknown
  Obtained from environmental sample
gtgcccgattccttcgtcatgaccactcgaagagtgcagggaggcaagttcgtcgccgaacccgggccgcctcgatatctgatcgtccccgaaggcgaattgccgaagccggagcatgagacaaacgtggcgctgtggatccgcaagctccgcaaagcagccacgtggggcaaggattcgcgcgatccgcgccgcgcgcgcggcgacatcctcttcttcgtccacggctataacaacgatcaccagttggtgctggccaggcaccggcgcctgaagacagacctcgccgccgccggcttccttggcgaggttgccaccttcgactggcccagcgccagcatgtccctcaattacatcgaggaccgccacgacgccaagcagaccgccatgctgctggtgacaggcggcatccgcctgctctccgaacggcaggagccggactgctccatcaacgtccaccttctcgggcactccacgggcgcctacgtgatccgcgaggccttcgacgatgccgacgatgcacggctcgccaacaacgcctggatggccagccaggtcgttttcatcggcgccgacgtctcctccggctccctcagccgcacgaatgccaggagcgaggcgctgtaccggcattgcgttcggctgaccaattactcgaaccgtttcgattccgtattgaagctttcgaacgtgaagcgcgccggcgtggcgccccgcgccggacgcgtcggcctgcctgcggacgcgccgccgaaagcggtggatgtggactgctccagctacttcgcactgctgcagggcgatccgcaagtgcaggccgaagaccaggcggaacggatcggcgcgttcgaccactcctggcacatcggcaaccgcatcttcgcccgggatctcttcgagaccctccgtggcgatctggaccgcaacaccctgccgactcgcgcgcagcgcgacggccgcctcgccctggtcagggcctga

SEQ ID NO: 344 - protein, 326 aa, Unknown
  Obtained from environmental sample
  DOMAIN (51)...(268): Protein of unknown function (DUF900)
MPDSFVMTTRRVQGGKFVAEPGPPRYLIVPEGELPKPEHETNVALWIRKLRKAATWGKDSRDPRRARGDILFFVHGYNNDHQLVLARHRRLKTDLAAAGFLGEVATFDWPSASMSLNYIEDRHDAKQTAMLLVTGGIRLLSERQEPDCSINVHLLGHSTGAYVIREAFDDADDARLANNAWMASQVVFIGADVSSGSLSRTNARSEALYRHCVRLTNYSNRFDSVLKLSNVKRAGVAPRAGRVGLPADAPPKAVDVDCSSYFALLQGDPQVQAEDQAERIGAFDHSWHIGNRIFARDLFETLRGDLDRNTLPTRAQRDGRLALVRA

SEQ ID NO: 345 - DNA, 1422 bp, Unknown
  Obtained from environmental sample
atgaaaaagaaattatgtacactggcttttgtaacagcaatatcttctatcgctatcacaattccaacagaagcacaagcttgtggaataggcgaagtaatgaaacaggagaaccaagagcacaaacgtgtgaagagatggtctgcggaacatccacatcatcctaatgaaagtacgcacttatggattgcgcgaaatgcaattcaaataatggcccgtaatcaagataagacggttcaagaaaatgaattacaatttttaaatactcctgaatataaggagttatttgaaagaggtctttatgatgctgattaccttgatgaatttaacgatggaggtacaggtacaatcggcattgatgggctaattaaaggagggtggaaatctcatttttacgatcccgatacgagaaagaactataaaggggaagaagaaccaacagctctctctcaaggagataaatattttaaattagcaggcgattactttaagaaagaggattggaaacaagctttctattatttaggtgttgcgacgcactacttcacagatgctactcagccaatgcatgctgctaattttacagccgtcgacacgagtgctttaaagtttcatagcgcttttgaaaattatgtgacgacaattcagacacagtatgaagtatctgatggtgagggcgtatataatttagtgaattctaatgatccaaaacagtggatccatgaaacagcgagactcgcaaaagtggaaatcgggaacattaccaatgacgagattaaatctcactataataaaggaaacaatgctctttggcaacaagaagttatgccagctgtccagaggagtttagagaacgcacaaagaaacacggcgggatttattcatttatggtttaaaacatttgttggcaatactgccgctgaagaaattgaaaatactgtagtgaaagattctaaaggagaagcaatacaagataataaaaaatacttcgtagtgccaagtgagtttctaaatagaggtttgacctttgaagtatatgcaaggaatgactatgcactattatctaattacgtagatgatagtaaagttcatggtacgccagttcagtttgtatttgataaagataataacggtatccttcatcgaggagaaagtatactgctgaaaatgacgcaatctaactatgataattacgtatttctaaactactctaacttgacaaactgggtacatcttgcgcaacaaaaaacaaatactgcacagtttaaagtgtatccaaatccgaataacccatctgaatattacctatatacagatggatacccagtaaattatcaagaaaatggtaacggaaagagctggattgtgttaggaaagaaaacagatacaccaaaagcttggaaatttatacaggctgaatag

SEQ ID NO: 346 - protein, 473 aa, Unknown
  Obtained from environmental sample
  SIGNAL (1)...(27)
  DOMAIN (1)...(303): Zinc dependent phospholipase C
MKKKLCTLAFVTAISSIAITIPTEAQACGIGEVMKQENQEHKRVKRWSAEHPHHPNESTHLWIARNAIQIMARNQDKTVQENELQFLNTPEYKELFERGLYDADYLDEFNDGGTGTIGIDGLIKGGWKSHFYDPDTRKNYKGEEEPTALSQGDKYFKLAGDYFKKEDWKQAFYYLGVATHYFTDATQPMHAANFTAVDTSALKFHSAFENYVTTIQTQYEVSDGEGVYNLVNSNDPKQWIHETARLAKVEIGNITNDEIKSHYNKGNNALWQQEVMPAVQRSLENAQRNTAGFIHLWFKTFVGNTAAEEIENTVVKDSKGEAIQDNKKYFVVPSEFLNRGLTFEVYARNDYALLSNYVDDSKVHGTPVQFVFDKDNNGILHRGESILLKMTQSNYDNYVFLNYSNLTNWVHLAQQKTNTAQFKVYPNPNNPSEYYLYTDGYPVNYQENGNGKSWIVLGKKTDTPKAWKFIQAE

SEQ ID NO: 347 - DNA, 963 bp, Unknown
  Obtained from environmental sample
gtgattactttgataaaaaaatgtttattagtattgacgatgactctattgttaggggttttcgtaccgctgcagccatcacatgctactgaaaattatccaaatgattttaaactgttgcaacataatgtatttttattgcctgaatcagtttcttattggggtcaggacgagcgtgcagattatatgagtaatgcagattacttcaagggacatgatgctctgctcttaaatgagctttttgacaatggaaattcgaacatgctgctaatgaacttatccacggaatatccatatcaaactccagtgcttggccgttcgatgagtggatgggatgaaactagaggaagctattctaattttgtacccgaagatggcggtgtagcaattatcagtaaatggccaatcgtggagaaaatacagcatgtttacgcgaatggttgcggtgcagactattatgcaaataaaggatttgtttatgcaaaagtacaaaaaggggataaattctatcatcttatcagcactcatgctcaagccgaagatactgggtgtgatcagggtgaaggagcagaaattcgtcattcacagtttcaagaaatcaacgactttattaaaaataaaaacattccgaaagatgaagtagtatttattggtggtgactttaatgtgatgaagagtgacacaacagagtacaatagcatgttatcaacattaaatgtcaatgcgcctaccgaatatttagggcatagctctacttgggacccagaaacgaacagcattacaggttacaattaccctgattatgcgccacagcatttagattatatttttgtggaaaaagatcataaacaaccaagttcatgggtaaatgaaacgattactccgaagtctccaacttggaaggcaatctatgagtataatgattattccgatcactatcctgttaaagcatacgtaaaataa

SEQ ID NO: 348 - protein, 320 aa, Unknown
  Obtained from environmental sample
  SIGNAL (1)...(29)
  DOMAIN (37)...(319): Endonuclease/Exonuclease/phosphatase family
MITLIKKCLLVLTMTLLLGVFVPLQPSHATENYPNDFKLLQHNVFLLPESVSYWGQDERADYMSNADYFKGHDALLLNELFDNGNSNMLLMNLSTEYPYQTPVLGRSMSGWDETRGSYSNFVPEDGGVAIISKWPIVEKIQHVYANGCGADYYANKGFVYAKVQKGDKFYHLISTHAQAEDTGCDQGEGAEIRHSQFQEINDFIKNKNIPKDEVVFIGGDFNVMKSDTTEYNSMLSTLNVNAPTEYLGHSSTWDPETNSITGYNYPDYAPQHLDYIFVEKDHKQPSSWVNETITPKSPTWKAIYEYNDYSDHYPVKAYVK

SEQ ID NO: 349 - DNA, 579 bp, Unknown
  Obtained from environmental sample
gtgagccacctgctgtacctgcacggctttcgctcgtcgccgcgctcgaccaaggcgcagatggtcgccgagcgcgtcgcgcgcgaccacccacgcgtgacctggtgctgcccccagttgccgccctcacccgcagcggcctgggccttgatcgagcgcaccgtggcagactggccccggggcgcgatgggcgtcatcggctcatcgctgggtggcttttacgccacccggctggcggcgctgaccggctgccgcgcggtgctgctcaacccggcggtggacccggcgcgcgacttggcgcgccacatcggcgagcacaccgcgtggcacgacccgcaggagcgctttttctttcggcccgagtacgtgcaggagctgcgcgcgctggcggtgggcgccctgcccgacccggcgcgcgtgctgctggtggccgccaccggcgacgaagtgttggactggcgcgagatggtggcgcgctaccccggcagcccgcagcgcatcgtgcccggcagcgatcacgcgctgtcggacttcgccgcgcacctggacgcggtgctggcgcacctgaacctggtttga

SEQ ID NO: 350 - protein, 192 aa, Unknown
  Obtained from environmental sample
  DOMAIN (3)...(190): Uncharacterised protein family (UPF0227)
MSHLLYLHGFRSSPRSTKAQMVAERVARDHPRVTWCCPQLPPSPAAAWALIERTVADWPRGAMGVIGSSLGGFYATRLAALTGCRAVLLNPAVDPARDLARHIGEHTAWHDPQERFFFRPEYVQELRALAVGALPDPARVLLVAATGDEVLDWREMVARYPGSPQRIVPGSDHALSDFAAHLDAVLAHLNLV

SEQ ID NO: 351 - DNA, 1788 bp, Unknown
  Obtained from environmental sample
gtggctaggcaagccagagccgacgtggtgaccatcggggcagggtggagcgccgccatcctcgcctggaagctcaccgaggcgggctacaaggtggtttccatcgagcaggggccgatgcgctacacctatcccgactttgcccacaaccacgacgcgcttcgctaccaaaaccgcttcgcgctcatgcacaacctcgcccgggagagctggacctggcgccctaatgcgcgggcgccggccttgcccatgcgccgctacggcgcctttcatcccggccagggctttggcggcgcgggcgtgcactggtcggcgatgcactaccgcttcatgcccgaggactttcgctaccgcagccaccatatcgagcgctacggcgcggacaagctgcccgagggcaatgccatccaggactggcctctaagctacgaggagctcgagccctattacgctcagttcgactgggacctcggggtgtcgggccaggtgggcaacctgcgcggcgagcctcaagagggcggcaatcccttcgagggctttcactcgcggccctacccgctgcccccgctcaccaccaacatccccgcggagatgttcaaggaggcctgccgcgagcttggctaccatcccttccccaacccctcgggcatccactcgcaggcctataccgaccgcttcggcaacgtccgggccggctgccagtactgcggcttttgcacccgctacggctgccacgtcgatgccaaggcgagcggccacaacgtccacgcgccggtggcgttaagaacgggcctttgggacatccgcccacatgccaaggcaacgcgcatcaacaccggccagggcggcctcgccaccggcgtctcctatatcgaccttgccagcggcgaggagcacgagcaacccgccgaggtcgtcatcagcacgggctacaccatgacgaacgtgcgcacgctgatgctctctagaagcagcgcgcacccgagcggcatcggcagcgaccgcggccagctcggcaggaactttacctatcaggtctggcaagctccggccacgggcgtcttcgagggccgccgcttcaacctcttcatgggcaacacctcgacgcaaaacaccatctacgacttctacggcgacaacttcgaccacgcggatctggacttcatgggcgggggcggcatctactgcaccccaggcgagcgcgagcccgtcggcgcggcgggcgccgcgccctttggcgaggcgggcgacggcgagggccccacgagaggctggggccgggagtggaaggagatgttcaagatgagttgggactcctttgcgcctattctcttccagggcgagagcatggcctaccaggaccatcgtttcgacttagaccccaactaccgcgactcgttcggcctgcccctcttgcgctttaccttcgacttcaaggagaacgaaaagaacatgtaccgcttcatcgcgcggcgggtgatcgagatcatggagcggatgaacccctcttggatgcagaccgaggaggagctggagcccttcaacatccacgactaccagagcacccacatcaacggcggcgccatcatgggcacggaccccggcaactcggtcaccaaccgctatggccaggtctgggacacacccaacgtctttgtcaccggcgcggcgctctacccgcaaaaccccggcgccaacccctcggccaccatgggcgcgctcgcctacctggcgggcgaggcgctggtcgagcgctactttagaaatcctcgagagcttctcgtctaa

SEQ ID NO: 352 - protein, 595 aa, Unknown
  Obtained from environmental sample
MARQARADVVTIGAGWSAAILAWKLTEAGYKVVSIEQGPMRYTYPDFAHNHDALRYQNRFALMHNLARESWTWRPNARAPALPMRRYGAFHPGQGFGGAGVHWSAMHYRFMPEDFRYRSHHIERYGADKLPEGNAIQDWPLSYEELEPYYAQFDWDLGVSGQVGNLRGEPQEGGNPFEGFHSRPYPLPPLTTNIPAEMFKEACRELGYHPFPNPSGIHSQAYTDRFGNVRAGCQYCGFCTRYGCHVDAKASGHNVHAPVALRTGLWDIRPHAKATRINTGQGGLATGVSYIDLASGEEHEQPAEVVISTGYTMTNVRTLMLSRSSAHPSGIGSDRGQLGRNFTYQVWQAPATGVFEGRRFNLFMGNTSTQNTIYDFYGDNFDHADLDFMGGGGIYCTPGEREPVGAAGAAPFGEAGDGEGPTRGWGREWKEMFKMSWDSFAPILFQGESMAYQDHRFDLDPNYRDSFGLPLLRFTFDFKENEKNMYRFIARRVIEIMERMNPSWMQTEEELEPFNIHDYQSTHINGGAIMGTDPGNSVTNRYGQVWDTPNVFVTGAALYPQNPGANPSATMGALAYLAGEALVERYFRNPRELLV

SEQ ID NO: 353 - DNA, 1728 bp, Unknown
  Obtained from environmental sample
atgggggatatgacattcgcgatgcgtcgtcacgggacgcgatttgccgcagcgggcttgcttctgctgctgctgggcggcctgctggcttcccttatccagacgtcgaacggcattcgagtcatggacgtccgcttcgcgggaagcgacggcaccgcaatgagcgcgctgctctacgtaccaccgaccgcgagcgcaaaagcgcccgcgcctggaatcctcgccgttcatgggtacttcaattcgcgcgaggcccagagcggctttgccattgagtttgcgcgacgcggatacgtcgtgttggcactagatcaaaccggccacggttacagcgatccacctgcgttctcgaacggcttcggcgggcccgatgggctggcctacttgcgcagcctggatttcgtggacaagaacaacatcggtttggaaggtcacagcatgggcggatggaccgttctgaatgccgccgccgcttttcctgatggctacaaatccgtggtcctcgaaggttccagcactggagcaccgttcgcgcccgagggttccacggcgtttccgcgcaatctcgccgtggtatttgcacagttcgatgagttctcggcattcatgtggggagcgccaatcgcgcgggaagttgcccagagccagaagctgcagacaacattcggagtgaacgaggcggtgcagcccgggcgggtttatggctcgatcgaggagggcaatgcgcggatcctgcatacgccagcaggcactcacccgttcaatcacctttccacgcaggccataggccacagcatcgattggtttcagcgcactttggacggcggcacggccattgatcccgacgaccagatatggccctggaaggagctcggcaccaccctcgcgttcgtcggctgcatcatcctgatgctcggcgtgttcgagtgggcgctgggcactgcctatttcgcacccctggcgaaggaatccgcacccgccactacacggggcggagtggcttggtggcttgcgctctccctcagcatcacgctgccggtactcacgttttttactttcctgcagctcggcgaacgcctcgctcctgcatcggtcgtatggccgcagggcttcagcaaccaaatcgtcttgtgggctctgctcaatgcgctgctcttcgcagggctgtcacttttgcccggcaatccgcgacggactttcgactcccgcccgtggcgatcgttcgtgctggcgttcctcacggtcgccagcgcctatgcagcactcgcggtcgctgacttcctgtttacaatagatttccgcttctggttcatcgcgctcaagctgttgagccgcgatcaggcgatctcgttcctcgcctatctggtacctttcgccgctttcttcttggtcatattgcgcggcttacacaccaacctgccgcttaagaatgcctcgccagggttgcaatacgccatcaacatcgcggcgcttgccggtggattcgcgttgttcgtgctcgttcagtacggccttctattcagcaccggccggctgctgacgttctacatgaatgacaatttgcgaaccatcatagccatccaattcatacccctgatggcgattgtcgcggtcatttcgacgttcgcgtttcgacgcaccgacagctacgtgccgggcgccatcgtctgcgccctgttcgttacatggtatgtggtggccggacaagcaacgcacgtggctagatga

SEQ ID NO: 354 - protein, 575 aa, Unknown
  Obtained from environmental sample
MGDMTFAMRRHGTRFAAAGLLLLLLGGLLASLIQTSNGIRVMDVRFAGSDGTAMSALLYVPPTASAKAPAPGILAVHGYFNSREAQSGFAIEFARRGYVVLALDQTGHGYSDPPAFSNGFGGPDGLAYLRSLDFVDKNNIGLEGHSMGGWTVLNAAAAFPDGYKSVVLEGSSTGAPFAPEGSTAFPRNLAVVFAQFDEFSAFMWGAPIAREVAQSQKLQTTFGVNEAVQPGRVYGSIEEGNARILHTPAGTHPFNHLSTQAIGHSIDWFQRTLDGGTAIDPDDQIWPWKELGTTLAFVGCIILMLGVFEWALGTAYFAPLAKESAPATTRGGVAWWLALSLSITLPVLTFFTFLQLGERLAPASVVWPQGFSNQIVLWALLNALLFAGLSLLPGNPRRTFDSRPWRSFVLAFLTVASAYAALAVADFLFTIDFRFWFIALKLLSRDQAISFLAYLVPFAAFFLVILRGLHTNLPLKNASPGLQYAINIAALAGGFALFVLVQYGLLFSTGRLLTFYMNDNLRTIIAIQFIPLMAIVAVISTFAFRRTDSYVPGAIVCALFVTWYVVAGQATHVAR

SEQ ID NO: 355 - DNA, 987 bp, Unknown
  Obtained from environmental sample
atgaacaatagcatcacaggaaaagatgggcagcggtctgctgcgaccgggttggtttggctgcagcaggttcggcagactttattgctcgccctgtgcttgttgacagtacatgcaacagcacaagccaacgaccaaatgacgccgatcacaacacctgagcagacacttgcaatagaacttggcaccccgccacttcctgctccggagtccggcgctttggcgcaggaatcctggcatgcgcaatatggcagtcgctttgcgcggaatgtcacagtagccacactgaccccattcctgcctgaaccgggtaaagccagtggtgccgcggtgatcgtcgcacccggtggtggctttcgcaccttatcgatggacaacgaaggctgggatgtcgcccgcaatctggccaagcagggcataaccgcttttgtgctgaaataccggttaaatcaaacaccggccgacatggctgattttaaacgttcgatggacgagatgttttcgcgccgtccgccccggccagatccggcacagatgttggtgcaactggcaccgcagcttgaagacgcccacgccgcttttgcgctgatacgtagtcgcgctggcgaatggcatatcgatccggaccggattggcatgattggattttctgccggcgccatgctgacgatggcaaccactttggccggcaaggacgccaaaccggcttttatcgccaatatctacggccccctggatgcggttgtggtcccggctgatgcaccaccactctttgtggcgctggcggctgacgatccattttttgcccatggtaaattcggtctgatcgagagttggcacgccgcgaaaaagccggtcgagtttcatttctatgagcaagggggtcacggctttggcatgtacccgaaggacaccaccagtaccaactggtttaatgcgttcgccagctggctagccatgcacgggatgctcaaacctaaagcgtga

SEQ ID NO: 356 - protein, 328 aa, Unknown
  Obtained from environmental sample
  SIGNAL (1)...(43)
MNNSITGKDGQRSAATGLVWLQQVRQTLLLALCLLTVHATAQANDQMTPITTPEQTLAIELGTPPLPAPESGALAQESWHAQYGSRFARNVTVATLTPFLPEPGKASGAAVIVAPGGGFRTLSMDNEGWDVARNLAKQGITAFVLKYRLNQTPADMADFKRSMDEMFSRRPPRPDPAQMLVQLAPQLEDAHAAFALIRSRAGEWHIDPDRIGMIGFSAGAMLTMATTLAGKDAKPAFIANIYGPLDAVVVPADAPPLFVALAADDPFFAHGKFGLIESWHAAKKPVEFHFYEQGGHGFGMYPKDTTSTNWFNAFASWLAMHGMLKPKA

SEQ ID NO: 357 - DNA, 849 bp, Unknown
  Obtained from environmental sample
atgaaaaagaaagtattagcactagcagctatggttgctttagctgcaccagttcaaagtgtagtgtttgcgcaaacaaataatagtgaaagtcctgcaccgatcttaagatggtcagctgaggacaagcataatgagggagttagtactcatttgtggattgtaaatcgtgcaattgacatcatgtctcgtaatacagcgattgtgaagccaaatgaaactgctttattaaatgagtggcgtactgatttagaaaatggtatttattctgctgattacgagaatccttattatgataatagtacatatgcttctcatttttacgatccggatactggaaaaacatatattccttttgcgaaacaggcaaaagaaacaggtacaaaatattttaaacttgctggtgaagcatacaaaaatcaagatatgaaacaggcattcttctatttaggattatcacttcattatttaggagatgtaaatcagccaatgcatgcagcaaactttacgaatctttcttatccaatgggtttccattctaaatatgaaaattttgttgatacaataaaaaataactatatagtttcagatagtagtggatattggaattggaaaggggcaaacccagaagattggattcaaggagcagcagtagcggctaaacaagattatcctggtattgtgaacgatacgacaaaagattggtttgtaaaagcagctgtatctcaagcatatgcagataaatggcgtgcagaagtaacaccggtgacaggaaaacgcttaatggaggcacagcgcgttacagctggttatattcatttatggtttgatacgtatgtaaatcactaa

SEQ ID NO: 358 - protein, 282 aa, Unknown
  Obtained from environmental sample
  SIGNAL (1)...(24)
  DOMAIN (1)...(281): Zinc dependent phospholipase C
MKKKVLALAAMVALAAPVQSVVFAQTNNSESPAPILRWSAEDKHNEGVSTHLWIVNRAIDIMSRNTAIVKPNETALLNEWRTDLENGIYSADYENPYYDNSTYASHFYDPDTGKTYIPFAKQAKETGTKYFKLAGEAYKNQDMKQAFFYLGLSLHYLGDVNQPMHAANFTNLSYPMGFHSKYENFVDTIKNNYIVSDSSGYWNWKGANPEDWIQGAAVAAKQDYPGIVNDTTKDWFVKAAVSQAYADKWRAEVTPVTGKRLMEAQRVTAGYIHLWFDTYVNH

SEQ ID NO: 359 - DNA, 1197 bp, Unknown
  Obtained from environmental sample
atgaactggcagcgttattcgaccggtgtggcggccctcgccttctggtctttttgcagtcaaccgctctcggcccagcaggccgccaagccgctggcggtggcggcccccgccgacgccggcatggaccccgccgtgctcggccagatcgccgagcgcatgaaggagttcgtcgagaagcggcaggcctccggcgtggtcacgctggtcgccagggacggcaagatcgtgcaacacgaggcggtcggttatgccgacctggaccagcagaggccgatggccagggactcgctcttcgccatcgccagcatgaccaagccgatcgccaccaccgccctgatgatcctggtggatgagaagaaggcggcgctcgacgacccggtggcgaagtacctccccgagttcaaggacgtgaagctgaaggacggcacgagtccgaagcaggcgatcctggtgcggcacctgctgacgcacacggctggcctggccggcagtcagcagaacgtcggtacgctcaaggagacggccgcggcggtcgcccagcggccgctcgaattcgagccgggcagccgctggcagtacagcccgggcatcagcgtggcgggccgggtcgtcgaggcggcctcgggccagccgttcgacgagttcctggccagccggatcttccgcccgctgggcatggttgacaccaccttccgacctagcccggagcagcagaagcggctggcccgcctctaccagccgaccaaggacaagcaaggcatcgaagcgaccgaccactggctcctccaggagaccaacccgaacccctcgggcggcttgttctcgaccgccggcgacctggcccgtttctaccagatgatcctcaacggcggcgagctcgacggccagcggatcgtctccccgcaagcggtcgccgagatgacccggctccagactggcgagcttgccaccggcttcacgcccggcaacggctgggggctcggcttctgcctggtgcggaagccgcagggggtgacgcagtcgctgtcgccgggcagcttcggccatggcggggccttcggcacgcagggctggctcgaccccaagcggcggatgttcttcgtgctgctgatccagcgcaccggcttcggcaacagcgacgcctccgagttgcgcggggctctgcaggacctggcggtgcaggccatccaatag

SEQ ID NO: 360 - protein, 398 aa, Unknown
  Obtained from environmental sample
  SIGNAL (1)...(25)
  DOMAIN (50)...(393): Beta-lactamase
MNWQRYSTGVAALAFWSFCSQPLSAQQAAKPLAVAAPADAGMDPAVLGQIAERMKEFVEKRQASGVVTLVARDGKIVQHEAVGYADLDQQRPMARDSLFAIASMTKPIATTALMILVDEKKAALDDPVAKYLPEFKDVKLKDGTSPKQAILVRHLLTHTAGLAGSQQNVGTLKETAAAVAQRPLEFEPGSRWQYSPGISVAGRVVEAASGQPFDEFLASRIFRPLGMVDTTFRPSPEQQKRLARLYQPTKDKQGIEATDHWLLQETNPNPSGGLFSTAGDLARFYQMILNGGELDGQRIVSPQAVAEMTRLQTGELATGFTPGNGWGLGFCLVRKPQGVTQSLSPGSFGHGGAFGTQGWLDPKRRMFFVLLIQRTGFGNSDASELRGALQDLAVQAIQ

SEQ ID NO: 361 - DNA, 1200 bp, Bacteria
atgaaacgtaaatttactaaaacggtacttaatgcagtttttgtcttagggttatgctctattatggggggaacatcttatgcttgggatggaaaaaaagacggaactggaacacatgcacttattgcagaacatggattaactatgttaaataatgatttaaatcaaaatgaaccaaagccaataaaacaaaacatagaaatattaaacaaatatttgaaagacttaaaattaggatcaactttcccagactatgaccctaatgcatatgatttatttcaagaccatttctttgacccagatacaggtaacaactttacattagataataaatggtatgtagcatctcctatttatgatacagctgaaacacaagtaagaaaatttgctactttagctgaaaatgaatggaaaaaaggaaattataaagaagctacatttttattaggtcaaggaatgcattatttaggggatttaaatacaccataccatgcagctaatgtaactgcagtagatagtccaggtcatgtaaagtatgaaacatttgtagaaaacagaaaagagaattatgctttaaatacagctggaaatgatacaactcaaggaatatataaagatgcagtagctaataaggattttgatcaatggatgactcaaaactctgtaaaatatgctaaaaaggcaaaagctttatattacagccattcaactatgaaacataattgggatgattgggattattcaggaagagaagcgataaaaaattctcaagtatgtacagcaggatttttatatagatttataaatgaggtttcagaagatcaaatttcaggaaacaatttaacaaatgaatttaatgtagttttaaaaactgcagacaatgaatatgcaggaactgacgataatgtatattttggatttgaaactaaagatggaagtaagtatgaatggaatttagataatgcaggaaatgattttgaaaaaaatcaaacagataattatatactaaaagtgaagaatgatgtaaaagttaacacaaatgatataacaaaatattgggttagaaaagaaaatagaacaccaataagtgacgattgggaattaagtaatataaaattaatatcaaatggaaaagtaattcttcaaaaagatattaataaggtattttcaggtaatcaagtttatgatataaacaaataa

SEQ ID NO: 362 - protein, 399 aa, Bacteria
  SIGNAL (1)...(28)
  DOMAIN (283)...(399): PLAT/LH2 domain
  DOMAIN (1)...(278): Zinc dependent phospholipase C
MKRKFTKTVLNAVFVLGLCSIMGGTSYAWDGKKDGTGTHALIAEHGLTMLNNDLNQNEPKPIKQNIEILNKYLKDLKLGSTFPDYDPNAYDLFQDHFFDPDTGNNFTLDNKWYVASPIYDTAETQVRKFATLAENEWKKGNYKEATFLLGQGMHYLGDLNTPYHAANVTAVDSPGHVKYETFVENRKENYALNTAGNDTTQGIYKDAVANKDFDQWMTQNSVKYAKKAKALYYSHSTMKHNWDDWDYSGREAIKNSQVCTAGFLYRFINEVSEDQISGNNLTNEFNVVLKTADNEYAGTDDNVYFGFETKDGSKYEWNLDNAGNDFEKNQTDNYILKVKNDVKVNTNDITKYWVRKENRTPISDDWELSNIKLISNGKVILQKDINKVFSGNQVYDINK

SEQ ID NO: 363 - DNA, 1443 bp, Unknown
  Obtained from environmental sample
gtggcgctcctgcagcggacgcgaagcgggatggcgcagcaggcggtcgatggagggcaggcgaatggcggtcatgggagcctcttgggtcgagtcgacccccagtgtagcccgaaccggcggcgggtcgaccagggcgcgccgggctgctgcaggcctggtctactccgcgacgaaggggccgggcccggacctcggtcgtctgaaaatgacccccgggttcccggtttgccgcgtgccagagcccgtcctaggatggtttcgcaggctcttcccaggcagctgccacggtcctggcgtggagagccctggccaccacgtccacctcacgacaataacaaaggtgccgtcatgtccaagaaatcctccctctgggccagcgatggcctgctcgacaacagcgacatcgtcagcctcggcaacttcacctacctgcacacgctgaagagcgccgcagccacgccactggcgcagacccactcggccagcacccccaccgtcagcgaattcctcaacggcgccatcagcgaatacgtactcaatggcacgcctgacggcatgcggcccttcctgatggatggccaccaaatgacgctgcacaactcgctcaatggcgccacggcccacacctggatcaccgccgagaatcagctgctcatcacctatgccggcactaccagaggcgagaatctgctgatcgaccccctttccaccgccggtggcctgctgagcgatctgcagatcctcagccagcaggtctccagcgcccagcgccaatcgctggacttcgcccaccaggtgatcgaggcggcggccaagcagggctacggcacccaggacatctttgtcaccggccactccctggggggcatctcggcggcctacgtcgcccagcagaccggtctcggcggcatcagcttcgaggcctcgggcattccccgcgatggtcaggcggcgggccacggcggcaatttcgtcaatgtggtcaccctcggcgatccggtggccaactacagctccgacatccgcggcgaacagcccttcgcccccagcttcgtcagccaggccgagggtggcggcagcctgccccactatggctcgctgttcctgatcggtgcccaggccgaccagcacgacctgagccaggcggcggccaaggtcggccacctgttcaacggcgacaacggcggccaggtcaatccactgggggcggccctgcatccgctcagcgtcgccgccgggatcgccgaagcggcgcgcctgatcgccgaattccatctgccggccgccgaatacaccaacctcggcgtgacccctaccggcggctttctcgacaccctgccggcgcagatcggcacggcccatggtccggtgctgatggtcggcaactacagcgtggcggaattgcaggcctttgccgagacccacgccaccttcggctga

SEQ ID NO: 364 - protein, 480 aa, Unknown
  Obtained from environmental sample
MALLQRTRSGMAQQAVDGGQANGGHGSLLGRVDPQCSPNRRRVDQGAPGCCRPGLLRDEGAGPGPRSSENDPRVPGLPRARARPRMVSQALPRQLPRSWRGEPWPPRPPHDNNKGAVMSKKSSLWASDGLLDNSDIVSLGNFTYLHTLKSAAATPLAQTHSASTPTVSEFLNGAISEYVLNGTPDGMRPFLMDGHQMTLHNSLNGATAHTWITAENQLLITYAGTTRGENLLIDPLSTAGGLLSDLQILSQQVSSAQRQSLDFAHQVIEAAAKQGYGTQDIFVTGHSLGGISAAYVAQQTGLGGISFEASGIPRDGQAAGHGGNFVNVVTLGDPVANYSSDIRGEQPFAPSFVSQAEGGGSLPHYGSLFLIGAQADQHDLSQAAAKVGHLFNGDNGGQVNPLGAALHPLSVAAGIAEAARLIAEFHLPAAEYTNLGVTPTGGFLDTLPAQIGTAHGPVLMVGNYSVAELQAFAETHATFG

SEQ ID NO: 365 - DNA, 609 bp, Unknown
  Obtained from environmental sample
atgatccgaattgaccaccgcaaaacgctcaaacatctctatcacccctcccacaagacacctgccctggtggaaatccccctcatgaacttcctgatgatggacgggcgcggcaaaccggatgggaaaccgttcccgcaagccgccagcgccctcttcccgctggcctacaccctcaagtggatggtgcgcctgggaagcgatatcgacttccacgttatgccaatggaggtacgctggagggtcaaccgcgagaagaaggaattcgcctggacgatgatgctgatgcaacccgaatacatcaccacagaattggtgaatgaagcccggcaaaaagtgttggccaaggtggtggacggttccctgctcgatcaggtgcgttttgaatcgtttgccgaggggctgtgcgtccagttcctgcatatcggcgcctacgagggcatggatgccgctctggagaatatgctggcagttgccgatgctcaaggctacagcgtccccacccgcaatgcccacgatatctacttgaacgatgtccggaaaacaaaaagtgagaatctaaaaaccattatgcgcctgccggttctccggcaggcaggtataaattga

SEQ ID NO: 366 - protein, 202 aa, Unknown
  Obtained from environmental sample
MIRIDHRKTLKHLYHPSHKTPALVEIPLMNFLMMDGRGKPDGKPFPQAASALFPLAYTLKWMVRLGSDIDFHVMPMEVRWRVNREKKEFAWTMMLMQPEYITTELVNEARQKVLAKVVDGSLLDQVRFESFAEGLCVQFLHIGAYEGMDAALENMLAVADAQGYSVPTRNAHDIYLNDVRKTKSENLKTIMRLPVLRQAGIN

SEQ ID NO: 367 - DNA, 1425 bp, Unknown; identical to SEQ ID NO: 35
  Obtained from environmental sample

SEQ ID NO: 368 - protein, 474 aa, Unknown; identical to SEQ ID NO: 36
  Obtained from environmental sample
  DOMAIN (133)...(265): Lipase (class 3)

SEQ ID NO: 369 - DNA, 789 bp, Unknown
  Obtained from environmental sample
atgaagtcgctattgccattgagcatcatcctggctggtctgtcgaccggctgcgcgctggagaacctcgagtccgacgagaacgagctcgccggcgccaactacgtcgcgatgggcgactcgtatgcttctggaaccgggacccgcgagtactaccattcggggtgtcagcggtcgaaccattcgtatgcgaagcagctcgccgccgcgagggggttgaacctctctcacgtcgcgtgctcgggggcgcgcatcccggacgtccgcgccaaccagctcggcgcgctctcggcctcgacgaacctcgtgacgatctcgatcggcggcaacgacgccgggttctcgagcgtgatcacccagtgcgcgaagccctggccgtatacgtgcaccaccgagatcaacaacgcgcggaacttcatcaacaacaccctccccggccagctcaatgcgctctacaccgagatcgacacgcgggccccgaatgcccaggtcatcgtcgtcggctatccgcggctgttcaacggcgaggagtgcaacctcctggcgcgtatcagccccaccgagcagagcgatctcaacgccgtcgccgacctgctcgcgaccaagatctcggcggccgcggctgcccgtggcttcgacttcgtggatgcgcgcggcccgttccagccccaccgcatctgcgatgacgtcgagtggctgaatggcctgtccaatccagtcggcgagtcgtatcacccgaacaagatcggccacgacgcgttcaccgatctcatcaatgcgaggctgtaa

SEQ ID NO: 370 - protein, 262 aa, Unknown
  Obtained from environmental sample
  DOMAIN (35)...(258): GDSL-like Lipase/Acylhydrolase
MKSLLPLSIILAGLSTGCALENLESDENELAGANYVAMGDSYASGTGTREYYHSGCQRSNHSYAKQLAAARGLNLSHVACSGARIPDVRANQLGALSASTNLVTISIGGNDAGFSSVITQCAKPWPYTCTTEINNARNFINNTLPGQLNALYTEIDTRAPNAQVIVVGYPRLFNGEECNLLARISPTEQSDLNAVADLLATKISAAAAARGFDFVDARGPFQPHRICDDVEWLNGLSNPVGESYHPNKIGHDAFTDLINARL

SEQ ID NO: 371 - DNA, 1509 bp, Unknown
  Obtained from environmental sample
atggtcaatcccagtattccactgattgaaacggtacagggccagttgatgggtgtcgtacaggatgacatccatctctggcgcggtattccttacgccgcaccgccgacgggagaacgtcgctggcgagcgccgcaaccggtcactccctggtcagggattcgtaatgcgaataccttctccagcgccagctggcaggacattgagtactgcaaagagttgggcggcggcgatcccggcgcattttctgaagattgtctctatctcaacgtctggtctccggcggagcgacatcagccgcttccggtgatggtctggctgcacggtggcggctacaccattggtgccggcaatctgccgccttatgacggcgttgcgctggcgaagcgtaacgtggttgtcgttaccgtcaactatcgcctcggtcatcttggcttttttgcccatccggcgctggaaggcgaagagggtgaggctctcaataactttgctttgctcgaccagattgctgcgctgcgctgggtacaggaaaacattgccgcgtttggcggcgatccgcaaaacgtcacgctgtttggtgaatcggccggggcgcgcagcgtgctctcgctgttagcttcgccgcgaggaaaagggctgtttcataaagcgattgtccagagcggctacacgttgccggacacgcctcgtgaaatagcgctggaaaacggcattgcgctggctgaacattttggcttgcagaatgcgacggcggaacagctacgtgcgattccggccgaggccttctggccgctgggcgcaccgtacaaaattgcgccgacacctatctccggcgatgcggtactgccggagccaatgctggacgtctttttcgccgccagacagcacccgatgcccgttatgattggttctaacagcgatgaagccagcgtgatggccgtcttcggcgtcgatcttgccggacaaattcagaaactgcgtcgtgaacgcaggctgggactcggcctgattaagctgctgtatccgggcgtgaagggcgatgaagaactggggcgacaggtgtgtcgggatatggcgtttacggcattaggttatgtggtgatgcaggcgcaacagcgggtcggcgagccgtgctggcgttactggttcgattacgttgcggaatcggagcatcacacctatgccaacggcgcctggcatggcaacgaagtgccttacgtctttaataccttaacgctcgctgaaccttcgcgaaattatgtgaacgaaaacgatctcgccttcgctgtccacgttgcggattactgggtcaattttgcccgtcatgccagtcggacctgcgatgttctgcatggaccggtccgctggcctgcctgtattcagggccgcgatcgggtgttacgtattgggctgaaaaagtttgccggttttaaggtcgagaaccggtttatgcgggcgcgactttcgctctttaaacgggtgatgacccagcacgtcagtctcgattag

SEQ ID NO: 372 - protein, 502 aa, Unknown
  Obtained from environmental sample
  DOMAIN (2)...(482): Carboxylesterase
MVNPSIPLIETVQGQLMGVVQDDIHLWRGIPYAAPPTGERRWRAPQPVTPWSGIRNANTFSSASWQDIEYCKELGGGDPGAFSEDCLYLNVWSPAERHQPLPVMVWLHGGGYTIGAGNLPPYDGVALAKRNVVVVTVNYRLGHLGFFAHPALEGEEGEALNNFALLDQIAALRWVQENIAAFGGDPQNVTLFGESAGARSVLSLLASPRGKGLFHKAIVQSGYTLPDTPREIALENGIALAEHFGLQNATAEQLRAIPAEAFWPLGAPYKIAPTPISGDAVLPEPMLDVFFAARQHPMPVMIGSNSDEASVMAVFGVDLAGQIQKLRRERRLGLGLIKLLYPGVKGDEELGRQVCRDMAFTALGYVVMQAQQRVGEPCWRYWFDYVAESEHHTYANGAWHGNEVPYVFNTLTLAEPSRNYVNENDLAFAVHVADYWVNFARHASRTCDVLHGPVRWPACIQGRDRVLRIGLKKFAGFKVENRFMRARLSLFKRVMTQHVSLD

SEQ ID NO: 373 - DNA, 759 bp, Fungi
atgtacgtctacaagcccgaccaggtcaagaccgatgcgctcgttgtagccattcacccctgcggatccaccggcccgagctactttggctgggcaccctggaaaaagggctcggattccaagggctacatctccgtgttcccgagcgcgacggcgtcgtgctgggatgtttcgagcaaggcgtcgttgtcgcataatggaggcggcgagtcgaatgctatcgctgatatgattacgtatgcgaccaagcagtacaacctcaatcccaagaaggtgtatgtggtgggagagtcttccggtgcgatgatgacgaatgtcttggccgcgacataccccgatcttatcgctgcgacttcggtgtactctggtgtcgctgctggatgctttgtgtcggcttctggagcggtggcggcgtggaacagtgaatgcgctcaaggacgttccatcaagactgcgcagcagtggggtgatattgcgcgcgcaatggatcctggctacaatggccagcgtcctcgtgttcaattctggcatggctctgttgatgccaccatcctcccgcccaactacaacgagacactcaagcagtggaccaacgtgtttggagtcagcactacgcctacaaggtcgcaggccaacacgccccagaccaactaccgcaccgacgattttggtcccaacgttcagggaatctgggcagttggtgtcggacacggtgtcccagctcaccaagctcaaactgaggcctggttcggattgtaa

SEQ ID NO: 374 - protein, 252 aa, Fungi
MYVYKPDQVKTDALVVAIHPCGSTGPSYFGWAPWKKGSDSKGYISVFPSATASCWDVSSKASLSHNGGGESNAIADMITYATKQYNLNPKKVYVVGESSGAMMTNVLAATYPDLIAATSVYSGVAAGCFVSASGAVAAWNSECAQGRSIKTAQQWGDIARAMDPGYNGQRPRVQFWHGSVDATILPPNYNETLKQWTNVFGVSTTPTRSQANTPQTNYRTDDFGPNVQGIWAVGVGHGVPAHQAQTEAWFGL

SEQ ID NO: 375 - DNA, 1050 bp, Unknown
  Obtained from environmental sample
atgctctggtttctgctcgctgtcgttactcttgttgtcctgatcacactgctgatcttccgggtaaaggatctttccgagtacgacggccaggactgggttatcaaggaagttgctccaaacccggctcatgatgaggtcatcgaacgcatcaaggacatggggcgcgcctcccgcggactgaagggcaaagcccggctgatcgccctccgcaaccatctggacagcctgggtgaaggcgtggatatcgaatcggacatccggcatcaggatcatccacgtggcgaatggatattggcgcccggggccgattcccgccgacgtgtgctctatattcacggcggtgcctgggctgctggcagccctcgcagtcaccgggcgattaccgaccgtttttcccggattgccaatgctgccgtttttgcggttgattaccggctcatgcccgaacaccggttcatggatggcattcgggactgccgccaggcctatgcatggctgctgaatcatggcccggacggcgaagcgcccgtcgactttatggtggttgccggagactcggcgggcggcagccataccctgtcactgctggcgtggattcgcgacaatggcctgcggcaggccgatgccgccgttgccctgtcaccctccacggatctcacgctgacggcgcctagcaatcgcgagaatattcgcacggacccactcctgggcccggtgtttggtggtttgtccaaaatcccgctgcccgtgttgtggtggggaacacttgccgcgttcagactctctcccaccaacccggttgcatcacctctgcggggtgagcttaacaagctgccacccgtgcttatccacgcaagcaccacggaaatgctgctggacaacgccacgcgttacgccgccaaggcaaaagcccagggttcaccggtggagcttcacacctggcagaacatggtgcatgtatggcacatcttcacgccactgctgcctgaggcagacgaggcattcgacgacatcgcggcttttctgaagaaagtggaacaaccttag

SEQ ID NO: 376 - protein, 349 aa, Unknown
  Obtained from environmental sample
MLWFLLAVVTLVVLITLLIFRVKDLSEYDGQDWVIKEVAPNPAHDEVIERIKDMGRASRGLKGKARLIALRNHLDSLGEGVDIESDIRHQDHPRGEWILAPGADSRRRVLYIHGGAWAAGSPRSHRAITDRFSRIANAAVFAVDYRLMPEHRFMDGIRDCRQAYAWLLNHGPDGEAPVDFMVVAGDSAGGSHTLSLLAWIRDNGLRQADAAVALSPSTDLTLTAPSNRENIRTDPLLGPVFGGLSKIPLPVLWWGTLAAFRLSPTNPVASPLRGELNKLPPVLIHASTTEMLLDNATRYAAKAKAQGSPVELHTWQNMVHVWHIFTPLLPEADEAFDDIAAFLKKVEQP

SEQ ID NO: 377 - DNA, 1044 bp, Unknown
  Obtained from environmental sample
atgaaaagatatttctatttgttcttatatcacctccttaccatacagttagttttcagtatatcactggaagcaaaaccgctgcttcttaaaaatgaatataaagttgctagggatgtagaatgggcaaaacctgatggattcagtctgacaatggatatctatacgcctgaaggtgataaagataattatccggtgctgcttatatttcacggcggtggttggctggcaaacgataaatctataatgaatgatatgagtcagtatgtggtccgacatggagactatgtagtgtgtaatattaattatagattgctcaaagaccagaacaataccgttaccatggaccagatagtggaagatgccttcggagcactgctatgggtcagagagcatgtcagtcaatatggaggtgatcctgaccggatagccgtatccggtgatagtgccggggggcacctggcggccatgatcgtaaatgccggtcctaatttaagtgagtcgggccttaaagatggagagaagggattcacgcccagctacattcctgaagggatgggtctggatgacataagggataagggctggatggaggttcagggggcagtattgaattacgccgctttagatatatataccttggcgaggaagggatatgaagaacaaaacaatagattttggcagggagcaggagtagaaccccgtggcattttcggcgatgattataatgtagaggataatcctgagctgtatcaggcggtgtctcccgttcatactctcccaagcgctacagagagaagattgcctccccaactactgactgttggaacagaagatgagcttataccaccgacacaaatcagagagtataaaaggcttttggaagaggcagggcatccggtagagtactgggagcacgaaggtagacctcatgcttttctggattcaggagaaaatcctcgtttgggtatcagctttgaagaggatgcccccgaggctttggataggattatagcttttctagatgctattttttaccaatag

SEQ ID NO: 378 - protein, 347 aa, Unknown
  Obtained from environmental sample
MKRYFYLFLYHLLTIQLVFSISLEAKPLLLKNEYKVARDVEWAKPDGFSLTMDIYTPEGDKDNYPVLLIFHGGGWLANDKSIMNDMSQYVVRHGDYVVCNINYRLLKDQNNTVTMDQIVEDAFGALLWVREHVSQYGGDPDRIAVSGDSAGGHLAAMIVNAGPNLSESGLKDGEKGFTPSYIPEGMGLDDIRDKGWMEVQGAVLNYAALDIYTLARKGYEEQNNRFWQGAGVEPRGIFGDDYNVEDNPELYQAVSPVHTLPSATERRLPPQLLTVGTEDELIPPTQIREYKRLLEEAGHPVEYWEHEGRPHAFLDSGENPRLGISFEEDAPEALDRIIAFLDAIFYQ

SEQ ID NO: 379 - DNA, 2049 bp, Bacteria
atggtgtttgaacaggatcctgcagcgcgctcgactttagaagtaataactacttacgctggattacatgcagtttggagtcacttaattgcccataaattatataaaaatagacgctatgtagcagccagaatgatttctcaactatcacgtttttttaccggaattgaaatacatccaggtgcaaaaatcggtaagcgtttatttatcgaccatggcatgggtgtagttattggagaaacatgtacaattgatcaatctaaaacaaatcaaaacaaccaacattctgtagctgaaagtgcacaactgaaaagtgatgagacagctaatcagccaaaaaaagaagaaggtagctcagtaaaacaagacgtccaaccgtctaaaaatgtaaatcaacaagacgtagctactcaatcaaatgagagagaaaataatgacataaaagatgaaggtcaaacttcaaagacgagcaatcaacatatccagagttctaacagtcataatcaatcaacaggaacaaaagacagctactcagaagaaatcgaccaaccattagtgaaattacaaaagccgtctaatgattctacatatcaaacacaatcaaaaacaaaacaagatagttctaaacaactccctcaagaaaaaacaacaaaacgtcaaattcaaacaactgaaaatgaacagacaactaaagttgattctaaaaaagctaatgacactcaaaatgttgaaaaacatactcaagagcctaaaaatgatacatcaacatcacaaaaaaatcatcaacaagtagctacaaaagaacaatctaatagaagtacaacaagggagacgcaaaagcaatcagcaaatgctaatcaaaatcatcagtctacacatcaagcacagttcaaaaaccaatatccagtagtatttgtccatggtttcctaggctttgcaggtgataatcaatttagtttagctccaaaatattggggtggtacaaaatacaatattgacagaaatttaactaatgagggatacaatgtacatgaggcaaatattggtgcttttagtagtaactatgatcgcgcagtagaattgtattactatgtcaaaggaggacgtgttgattacggtgcagcgcatgcagctaaatatggtcatcatcgctatggtcgaacatacaagggcatcatgcgtgattgggaacctggcaaaaaaattcattttataggtcacagtatgggtggtcaaaccattcgtcaaatggaagaattcttaagaaatggtaaccaagaagaaatagaatatcaacgtcaacatgggggtactatatccgatttatttacaggtggtaaagataatatggttgcttcaattactacacttggcacaccacataatggtacacctgctgcagataaaattggcacacgtaaacttgtaaaagaaacgattaatcgtattggtagattaagtggtggtaaagatgtagatatagatttaggtttttctcaatggggattaaaacaacaaccaaatgaaagctacattgattacgcggaacgtgtatccaaaagtaagatttggaatactgaagatcaagctgttaatgatctgacaacgcaaggtgctgaaaaaattaatcaacaaacaagtctaaatcctaatattgtctacactacttatacagggtcagcgactcacacaggacctcttggtaatgaattacctaattctagtgaaattcttttgttgaacttaaccagccgtattattggtaaagatgcaaacaaagaaattagaccgaatgatggtgtagttccagttatatcatcacaacatccttctaatcaagcctttaaaaaagttgatgatcatacaccagctactgataaaggtgtttggcaagtgagacccgttcaacatgattgggaccatttagatttagtaggtatggatgcatttgatttaacacatacaggtagagaattaggtcaattctatctaggtattatggataatatcatgagaatcgaagaagcagacggtattacaaataaataa

SEQ ID NO: 380 - protein, 682 aa, Bacteria
MVFEQDPAARSTLEVITTYAGLHAVWSHLIAHKLYKNRRYVAARMISQLSRFFTGIEIHPGAKIGKRLFIDHGMGVVIGETCTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 381 - DNA, 1287 bp, Unknown
  Obtained from environmental sample
gtgtcgattaccgtttaccggaagccctccggcgggtttggagcgatagttcctcaagcgaaaattgagaaccttgttttcgagggcggcggaccaaagggcctggtctatgtcggcgcggtcgaggttctcggcgaaaggggactgctggaagggatcgcaaatgtcggcggcgcttcagcaggcgccatgaccgctctagccgtcggtctgggactgagccccagggaaattcgcgcggtcgtctttaaccagaacattgcggacctcaccgatatcgagaagaccgtcgagccgtcctccgggattacaggcatgttcaagagcgtgttcaagaagggttggcaggcggtgcgcaacgtaaccggcacctctgacgagcgcgggcgcgggctctatcgcggcgagaagttgcgagcctggatcagagacctgattgcacagcgagtcgaggcggggcgctccgaggtcctgagccgagccgacgccgatggacggaacttctatgagaaagccgccgcaaagaagggcgccctgacatttgccgagcttgatcgggtggcgcaaatggcgccgggcctgcggcttcgccgcctggccttcaccggaaccaacttcacgtcgaagaagctcgaagtgttcagtctgcacgagaccccggacatgccgatcgacgtcgcggtacgcatctccgcatcgttgccatggtttttcaaatccgtgaaatggaacggctccgaatacatagatggcggctgcctgtcgaacttcccaatgccgatattcgacgtcgatccctatcgtggcgacgcatcgtcgaaaatccggctcggcatcttcggccagaacctcgcgacgctcggcttcaaggtcgacagcgaggaggagatccgcgacattctctggcgtagccccgagagcacgagcgacggctttttccaaggcatcctgtcaagcgtgaaagcttctgcagaacactgggtcgtcggcatcgacgtcgaaggcgccacccgcgcgtcgaacgtggccgttcacggcaagtatgctcagcgaacgatccagataccggacctcggatatagcacgttcaagttcgatctttcggacgctgacaaggagcgcatggccgaggccggcgcaaaggccacgcgggaatggctggcgctgtacttcgacgacgccggaatagaggtcgaattttctgatccgaacgaattgcgcggccagttgtccgacgccgcattcgcagacctcgaggattcgtttcgagccttgatcgcggcctag

SEQ ID NO: 382 - protein, 428 aa, Unknown
  Obtained from environmental sample
  DOMAIN (25)...(263): Patatin-like phospholipase
MSITVYRKPSGGFGAIVPQAKIENLVFEGGGPKGLVYVGAVEVLGERGLLEGIANVGGASAGAMTALAVGLGLSPREIRAVVFNQNIADLTDIEKTVEPSSGITGMFKSVFKKGWQAVRNVTGTSDERGRGLYRGEKLRAWIRDLIAQRVEAGRSEVLSRADADGRNFYEKAAAKKGALTFAELDRVAQMAPGLRLRRLAFTGTNFTSKKLEVFSLHETPDMPIDVAVRISASLPWFFKSVKWNGSEYIDGGCLSNFPMPIFDVDPYRGDASSKIRLGIFGQNLATLGFKVDSEEEIRDILWRSPESTSDGFFQGILSSVKASAEHWVVGIDVEGATRASNVAVHGKYAQRTIQIPDLGYSTFKFDLSDADKERMAEAGAKATREWLALYFDDAGIEVEFSDPNELRGQLSDAAFADLEDSFRALIAA

SEQ ID NO: 383 - DNA, 456 bp, Unknown
  Obtained from environmental sample
atgggagatcatatgaaccgtctcaaggaaatcagcgaactaaagcgccgcgccgatgagtttcagctggagaaccgcgaaatcatcggcaaatacacgctggaggaactctgctccatctacaacggcatcggaccggactcgtttccggactggctgcgcgacgtcatcagttcgcttcatccgagcctcgcgaccgtcgcgttcatacacgacatagagtggcacgagagcgatggctcgaaggagaagttcgccgaatcgaacgcccgtttcaaaaccaacggataccgggtcgccaaggctgagtacggctggtggaatccgctgcgctacatcgtgatgaaccaggcgcggcgcttcggcaatctctgtcaactcttcggctggccggcatggtgttcgccctgcgaatgcgccgtctgccgcaaaaaaaaggaaatggaaaatgcttaa

SEQ ID NO: 384 - protein, 151 aa, Unknown
  Obtained from environmental sample
MGDHMNRLKEISELKRRADEFQLENREIIGKYTLEELCSIYNGIGPDSFPDWLRDVISSLHPSLATVAFIHDIEWHESDGSKEKFAESNARFKTNGYRVAKAEYGWWNPLRYIVMNQARRFGNLCQLFGWPAWCSPCECAVCRKKKEMENA

SEQ ID NO: 385 - DNA, 1017 bp, Unknown
  Obtained from environmental sample
atgccagctaatgactcacccacgatcgactttaatcctcgcggcattcttcgcaacgctcacgcacaggttattttagcgacttccggcttgcgcaaagcgtttttgaaacgcacgcacaagagctacctcagcactgcccaatggctggagctcgatgccggcaacggagttaccttggccggagagcttaacacagcgcctgcaactgcatcctcctcccacccggcgcacaagaacactctggttattgtgctgcacggctgggaaggctccagccagtcggcctatgcgacctccgctggcagcacgcttttcgacaatgggttcgacacttttcgccttaattttcgcgatcacggcgacacctaccacttaaaccgcggcatatttaactcatcgctgattgacgaagtagtgggcgcagtcaaagccatccagcagcaaaccgactacgacaagtattgcctgatggggttctcactgggtgggaactttgccttgcgcgtcgcggtgcgggaacagcatctcgctaaaccgctagcgggcgtgctcgccgtatgcccggtactcgaccccgcacacaccatgatggccctaaaccgaggtgcgtttttctacggccgctattttgcgcataaatggaagcgctcgttaaccgcaaaacttgcagctttcccagactacaaatacggcaaagatttaaaatcgatacacacgcttgatgagttaaacaactatttcattccccgctacaccggcttcaactcagtctccgaatacttcaaaagttacacgctcaccgggcagaagctcgcgtttctcaactgccccagttacattctggcagctggcgacgacccaataattccagcatccgactttcagaaaatagccaagcctgcgaatctgcacataacagtaacgcaacaaggttctcattgcgcatacctggaaaacctgcataaacctagtgctgccgacaaatatgcggtgaaattatttggagcctgttga

SEQ ID NO: 386 - protein, 338 aa, Unknown
  Obtained from environmental sample
MPANDSPTIDFNPRGILRNAHAQVILATSGLRKAFLKRTHKSYLSTAQWLELDAGNGVTLAGELNTAPATASSSHPAHKNTLVIVLHGWEGSSQSAYATSAGSTLFDNGFDTFRLNFRDHGDTYHLNRGIFNSSLIDEVVGAVKAIQQQTDYDKYCLMGFSLGGNFALRVAVREQHLAKPLAGVLAVCPVLDPAHTMMALNRGAFFYGRYFAHKWKRSLTAKLAAFPDYKYGKDLKSIHTLDELNNYFIPRYTGFNSVSEYFKSYTLTGQKLAFLNCPSYILAAGDDPIIPASDFQKIAKPANLHITVTQQGSHCAYLENLHKPSAADKYAVKLFGAC

SEQ ID NO: 387 - DNA, 831 bp, Unknown
  Obtained from environmental sample
gtgatccagacatcttctctccacgtggaatcgtccggggaggggaagctctccgtggtcctggtgcacggcttcggcgccagcggccactcgtggcggaagtggcttccctcgctgaggagggaacacagggtccacgtgatcgacctgatgggagcgggccgggccgtggcgcctccctggggggactatacccccggggcccaggccgcacgcctggtggaggaactgaggcgcctcgggcgagggcccatcgtgctcatgggccactccctgggggcggcggtctcggtcctggccgccctccggatccgggacgcaggcggggccatccccgtcagcgggctcgtcctggtcggaggcgccgtccttccccagaagctcccgccgtacatatcggcggcccggacccccattctgggggaccttctcatgctggcctccccgcctcgctgggctctggagaggggcctcaagggaatcgtccacgaccccggcacggtcaatcgggagcaggtggagggataccgggaaccgctccggagcttccgccggcgaagggccctcctccgggccgcccggcaactcgatctcgcccagggagaggccctggccatacgcctccgcgagatcaccctccccaccctcctgatccacggccgggaagatggcgtgatcccgctggagatggggcagcggctctcccgggagatcccgggcgcccggctggtcatcctggacggggtggggcacctcccgccggaggaggccccggaagcgtccctggctcccgctctggagttcctggacgaactcagctctccgaagtga

SEQ ID NO: 388 - protein, 276 aa, Unknown
  Obtained from environmental sample
  DOMAIN (43)...(267): alpha/beta hydrolase fold
MIQTSSLHVESSGEGKLSVVLVHGFGASGHSWRKWLPSLRREHRVHVIDLMGAGRAVAPPWGDYTPGAQAARLVEELRRLGRGPIVLMGHSLGAAVSVLAALRIRDAGGAIPVSGLVLVGGAVLPQKLPPYISAARTPILGDLLMLASPPRWALERGLKGIVHDPGTVNREQVEGYREPLRSFRRRRALLRAARQLDLAQGEALAIRLREITLPTLLIHGREDGVIPLEMGQRLSREIPGARLVILDGVGHLPPEEAPEASLAPALEFLDELSSPK

SEQ ID NO: 389 - DNA, 915 bp, Unknown
  Obtained from environmental sample
atgtatgatgaaatccagaatcccgaatttgtcctctacaatgatcaaccgatcaggctttcagaactcctgcatgaacagaagcagttacgggacgaggttgccaggcagaagaagaatcagaaaaaggcgattcggcgcttcgaacgggaggaggcgctcaagccctatcaggctgaattgatacagatgcaacagtatctggagcggaccggtacccgcatgatcatcctcttcgagggacgcgatgccgccggcaagggcggtaccatccgccgcgtcacccgctacatgaacgaaaaacactaccgagtggtggcgctgggcaaacccactgaagagcagcgtacccaatggttcttccagaagtatgtgcgcgaatgtccatccggcggcgaggtggtactgttcgatcgcagttggtacaaccgcgccgtggtggagccaatctttggcttctgcacccaagaagagtacgaacatttcatgatcggctgccccggttttgagaaggatctggtgcgccagggtacgatcctggtcaagctctatttttcggtcaccaaggaggagcaggcgcggcgttttgaacggcgcaagagcgatcctttacggcagtggaagctttccgagatcgacgtacaggcgcaggatcgttgggatgacttcaccaatcagaagtatgagatgctgcgccgcaccaacaccactcacgcaccctggaccatcatccgctccaacgacaagcaccaagcccgcatcaacgccatgaaggtgatcctcaacgctgtgccttatcagcggctcgatccggaactcgactttgtgccggaccacgagatcgtcatctccggctcccgagaactggaattgatggaggcacaacgtctgcaaagcggcaagtttgttggatag

SEQ ID NO: 390 - protein, 304 aa, Unknown
  Obtained from environmental sample
  DOMAIN (44)...(272): Domain of unknown function (DUF344)
MYDEIQNPEFVLYNDQPIRLSELLHEQKQLRDEVARQKKNQKKAIRRFEREEALKPYQAELIQMQQYLERTGTRMIILFEGRDAAGKGGTIRRVTRYMNEKHYRVVALGKPTEEQRTQWFFQKYVRECPSGGEVVLFDRSWYNRAVVEPIFGFCTQEEYEHFMIGCPGFEKDLVRQGTILVKLYFSVTKEEQARRFERRKSDPLRQWKLSEIDVQAQDRWDDFTNQKYEMLRRTNTTHAPWTIIRSNDKHQARINAMKVILNAVPYQRLDPELDFVPDHEIVISGSRELELMEAQRLQSGKFVG

SEQ ID NO: 391 - DNA, 942 bp, Unknown
  Obtained from environmental sample
atgacgaccctattatggattctgatcctgatccttgccgggctcttgctgataacccggctgatctggcgctgggccgaacggcgagtgccaccggtaggcaaattctgtccggtcaagggcggcgtcattcactatgtcgaggccggcgatgcggacaaaccggttctggtcctgatccacgggctggcaggaatgctgcagcatttcagctatggcatgttggaaccgctgtcgcgcgaatatcgcgtgatcgcgctggaccgtcccggatgcggttattccacccgtgaccgggacgagttggcggcgccgctggtgcaggcacggatgatctggggcttcctggaccggatcggggtggaaaacccggttctggtcggccattcgctgggcggtgctatggcgctggccatggcgctggaacgacctgggggagcacgggccctggccctgatctgtcctgcatcccaatcgccgggaaccatccccgaggtttttcgccccttcgaggttgcctctcctgtggtgcggcgggtgatcggcaacctgctggccgtgccgatgggctggctgacaacggacaaggtcatgaaggctgtgttcgagccggaaccatggccccgggatttcctcgagcggggcggtgcaatgctcacctatcgcccgtccgcctttgtcggggcgtcggccgatcttgtcgaggcgcgcaatgccgtggatgacatgaccgcacgttatcgggatgagttaaaaacaccgggcgcgatcctgttcgggcgtgaggatgcgatcctgtcccccgacctgcacggaacggcgatggcagagttcggactgacttgcgaaatggttgagggtcgcggtcatatgctgccggtgaccgatcccgacgcctgttgcaatttcgtgcgccgggtggccgacatcatcaagccctga

SEQ ID NO: 392 - protein, 313 aa, Unknown
  Obtained from environmental sample
  DOMAIN (82)...(306): alpha/beta hydrolase fold
MTTLLWILILILAGLLLITRLIWRWAERRVPPVGKFCPVKGGVIHYVEAGDADKPVLVLIHGLAGMLQHFSYGMLEPLSREYRVIALDRPGCGYSTRDRDELAAPLVQARMIWGFLDRIGVENPVLVGHSLGGAMALAMALERPGGARALALICPASQSPGTIPEVFRPFEVASPVVRRVIGNLLAVPMGWLTTDKVMKAVFEPEPWPRDFLERGGAMLTYRPSAFVGASADLVEARNAVDDMTARYRDELKTPGAILFGREDAILSPDLHGTAMAEFGLTCEMVEGRGHMLPVTDPDACCNFVRRVADIIKP

SEQ ID NO: 393 - DNA, 1092 bp, Unknown
  Obtained from environmental sample
atgaccacatctacacaacacatcagcgagctacctctcttaccaggccgtctcggcgaccccgatcgcgtcttgaagactgatccccgtgccgatcctcggttggtcgccgcctgcgccccctttgctttagacgttgcgcccccacccgcaccggtgaacgcgcactcgcccttgcaggacaagctcgactacagtgcggccaacgaggcgggcatggaaaccgtgtttgccgccctgttcgccgacctcccgccgatgacgaacgtggagcggcggaccgaggtcatcaagggcgtggacggtaacgacatcaagctgtatatccatacgccccagcacgtttctggcccgctgccctgcgtgtatcatatacacggcggcggcatggtcattctgacggccgctggccctacctatgtacgctggcgggacgagcttgccgccctgggcatggtcgtggtgggtgtggaattccgtaatggcgccggcaagcttggcaaccatccctttccagccgggctcaacgactgcatgagtggcttacagtggacgtttgaccacaaaaccaccctggggatctcgaagataatcgtgtccggtgagtctggtggaggcaatctctccctggccgtgtgcctcaaggccaagaaggacaaacgccttgagcagattcatggtgtctacgccttgtgtccgtacatttatggcgcatgggcgcagaagagcaaagatctcccttccctatacgaaaacgacggctacttgatcaactgtagcctgatggaggtgctggcaagcgtctatgaccctgaaggcaaaaacgccaccaatccgctgtgctggccatactgggccacacgtgaggacctgcaaggtctgcctccgcatgtgatctcggtcaacgagttagaccccctgcgagacgaggggctgaaatactatcagaggctcctggcggctggggtgcgtgtatacagccggaccgtcaacggcacgtgccatgcgggcgacgtcctgttccgcaaagcgctcccggacgtgtacgcagccaccctccgcgatatcaaggggttcgcagactcgctgtag

SEQ ID NO: 394 - protein, 363 aa, Unknown
  Obtained from environmental sample
MTTSTQHISELPLLPGRLGDPDRVLKTDPRADPRLVAACAPFALDVAPPPAPVNAHSPLQDKLDYSAANEAGMETVFAALFADLPPMTNVERRTEVIKGVDGNDIKLYIHTPQHVSGPLPCVYHIHGGGMVILTAAGPTYVRWRDELAALGMVVVGVEFRNGAGKLGNHPFPAGLNDCMSGLQWTFDHKTTLGISKIIVSGESGGGNLSLAVCLKAKKDKRLEQIHGVYALCPYIYGAWAQKSKDLPSLYENDGYLINCSLMEVLASVYDPEGKNATNPLCWPYWATREDLQGLPPHVISVNELDPLRDEGLKYYQRLLAAGVRVYSRTVNGTCHAGDVLFRKALPDVYAATLRDIKGFADSL

SEQ ID NO: 395 - DNA, 408 bp, Unknown
  Obtained from environmental sample
atgaccatgcacgcagccgacatcgccagataccgaccaatctgcctcgcccttcctggcggggagatcctagaccgttacaccgatgaacaggccgccgctatctgcaacggtgtcggggccgcctgggtggaccgcatcgcgcctcacgcgtcggccatcctaaatcgccgtctcccatgggcggtcgccccgtcgatcattcacgaccttgcctatcacgagggcaggggaggagattccggacgcgccgccgcggattacaacttctggcggggatgccgccagcagatcgaggtcgtcagcgactacaagatcaccctctggtggcggaaccgcaaggccgacgtgctctaccgcacactgcggcgttttggccggctggcatgggagggaaaagatgactga

SEQ ID NO: 396 - protein, 135 aa, Unknown
  Obtained from environmental sample
MTMHAADIARYRPICLALPGGEILDRYTDEQAAAICNGVGAAWVDRIAPHASAILNRRLPWAVAPSIIHDLAYHEGRGGDSGRAAADYNFWRGCRQQIEVVSDYKITLWWRNRKADVLYRTLRRFGRLAWEGKDD

SEQ ID NO: 397 - DNA, 1176 bp, Unknown
  Obtained from environmental sample
atgcctgatgaaaaactcaatccggattctgtcgacaagactttccaaccgctcaaggagatgattgccgtcgaagtggacaagcgttcgcaactttggcgatcatggcacttcctgcaggtctattcttactggggcgtccggttgccgacaaccgagggcgacttcaacgccctgatgggtcattcgccggccgggtatgagttcttcccgccaatgcaggagggcaccaagcacatctccgacacctgcaaggattttctcacaaagacttaccctgcgatcgtcggcctgggacacgacctgctgaacttctccaagaacgcctcccccgacgacggcgcgctctttaacgaagtggcgaagttgatagacgagggcgccgccgcagatgcggtcacgctgctaacggatcttcaggcgacggcggacgattgcaagagccgcgccgaagcgcagaccaaaagtctggccgaattcaattccgaactcgtcgtggcgttgggaaagcttgccaccgctaaaatctccctcgacaaggacgagaagaccaacgaagcggagataaacaagcttgccggcaaggacgaccaggagggctcgcttgcctactatcgcaagcagattgcgaaccagcgcgaggagtataatcaactggtaaccatagccgccacgaccccgacctatgtctgggtctggccctttggcactattccggcgatcgtcgtcgcggggatctacactgatcgcgccataaaaaagctcaagcaaatcgagtcgatggaatcggacctgcgaaagaaggacgctggcctgttcgcggccaatcaggcgcgcctcatctattcagtcggggacgacggactgcggaacgtgactgtctacacccagcaagcccaggcccactgcaccatcgtgcaggatgcttgggcgggaatcagcggcaacatctcagaagtgaaagcctggatcgacaaggctacccacgctaatgccgagggcgtggtcgaaccccagtcgaagacgatcctgaaaatctacctgcaacgccttggcgcggcttggagcagcatgaaacctgcgctcatagatctgaccaccgatagcttcgtcacgctggaacccggcaacaagacgcccggccagttcgccgacgaggcaagcaaggccgcatga

SEQ ID NO: 398 - protein, 391 aa, Unknown
  Obtained from environmental sample
MPDEKLNPDSVDKTFQPLKEMIAVEVDKRSQLWRSWHFLQVYSYWGVRLPTTEGDFNALMGHSPAGYEFFPPMQEGTKHISDTCKDFLTKTYPAIVGLGHDLLNFSKNASPDDGALFNEVAKLIDEGAAADAVTLLTDLQATADDCKSRAEAQTKSLAEFNSELVVALGKLATAKISLDKDEKTNEAEINKLAGKDDQEGSLAYYRKQIANQREEYNQLVTIAATTPTYVWVWPFGTIPAIVVAGIYTDRAIKKLKQIESMESDLRKKDAGLFAANQARLIYSVGDDGLRNVTVYTQQAQAHCTIVQDAWAGISGNISEVKAWIDKATHANAEGVVEPQSKTILKIYLQRLGAAWSSMKPALIDLTTDSFVTLEPGNKTPGQFADEASKAA

SEQ ID NO: 399 - DNA, 1704 bp, Unknown
  Obtained from environmental sample
atgacaagcactcttggagaacgggccgtgcgcgcggccatggcgatcgcggcgggcggcgcgctggccgcctgtggcggcgtgtcgctggagcctgcggcgcccgcgccggtggcctgcgagaaattgcaggggctggccatcccggcggcgtccatcgggctgccgaccaccggtgccacggtgacctcggccaagctggtggaggccagcggcagcggcgccaccgccgtgccggcctactgcgaagtggcgggcaggattgcgccggtggatgccacggcccccaacatcctgttccaggtcggcctgccggtgaactggaaccagaaggccatgatgttcggcggcggcggcttcaacggcagcgtccccagcgtgaagaacaacgtgccggccgggccggccgaccagcccacgccgctgggccggggctatgcgaccttcgccagcgattccgggcaccagtccggcccgctgaccacgcgcgatggcctgttcgccatgaacgacgaatcgctgcgcaactacggcggcgatgccttgaagaaaacgcgcgacactgcagtggcgatcatccaggcgcactatggcaagctgccggcgacctcgtactttgccggtgggtcgaacggcgggcgcgagacgctgaccgccatccagcgctggccggccgactgggacggtgccatcgcctggtacccggcgtggaacgacgtggcggccctgctggccgggcaggtcatgggccgtgcgctggcacagcccggtgcctaccccaacccggccaagcggctcgcgctgttcgatgcggcgctggaggcctgtgatgcgctggacggcgtggccgatggggtcatcagccaccagaatgcgtgcaacgcgcgcttcgatccgtccaccgcaatgctgcgcggcgtgccgctgcgctgccccggcggtgccgatacgggagactcctgcctgtcggatgcacagatcgtggcgctcaagaagatcaacagcccgttcagcttcaaggcgcccatgctcaacggcgacaccgaccacccgggcttcaacgtctggggggctgacaccggcatcactgcctggaacaagccgacccaggcgtacgtgagcctggtgaacttcaacacctcgcagccggcgtttcccatgcccgtcacggcgcccttcatggccatcctgggcgaccaatgggtgcgttacttcgtggcgcgcgacccgaacctcaactccctgggcttcgatccggagaacctggggccgtggacggcccgcgtgcaggaggtcagccggctgctggacgccaagacggacatctccgccttccaggcccgcggcggcaagctgctgattgcccatggcctggccgatacggtcgtcagctcgcgccccacacaggaatactaccgccgcctgcaggcccagttcggcgcgtcgaaggtggccgggttcgttcgctactacgaggtgcctggctacggccatgcgtccagccaggtgttcaacgcggcatgggattcgctgacggcgctggacgcctggcgcgtcgacggcaagatccccgtggcccaggtggtgacggacatcaccggggtgccgggccgcacgcggccgatgtgcgagtacccggcctggccacggtacaagggcagcggcgacgcgaacctggcggcgtcgttcgagtgcgcgcaatag

SEQ ID NO: 400 - protein, 567 aa, Unknown
  Obtained from environmental sample
MTSTLGERAVRAAMAIAAGGALAACGGVSLEPAAPAPVACEKLQGLAIPAASIGLPTTGATVTSAKLVEASGSGATAVPAYCEVAGRIAPVDATAPNILFQVGLPVNWNQKAMMFGGGGFNGSVPSVKNNVPAGPADQPTPLGRGYATFASDSGHQSGPLTTRDGLFAMNDESLRNYGGDALKKTRDTAVAIIQAHYGKLPATSYFAGGSNGGRETLTAIQRWPADWDGAIAWYPAWNDVAALLAGQVMGRALAQPGAYPNPAKRLALFDAALEACDALDGVADGVISHQNACNARFDPSTAMLRGVPLRCPGGADTGDSCLSDAQIVALKKINSPFSFKAPMLNGDTDHPGFNVWGADTGITAWNKPTQAYVSLVNFNTSQPAFPMPVTAPFMAILGDQWVRYFVARDPNLNSLGFDPENLGPWTARVQEVSRLLDAKTDISAFQARGGKLLIAHGLADTVVSSRPTQEYYRRLQAQFGASKVAGFVRYYEVPGYGHASSQVFNAAWDSLTALDAWRVDGKIPVAQVVTDITGVPGRTRPMCEYPAWPRYKGSGDANLAASFECAQ

SEQ ID NO: 401 - DNA, 774 bp, Unknown
  Obtained from environmental sample
atgtattttgaatataagaatcgaaagattttttacaatatagaaggatcgggtcctgtcatattgtttttacacggtcttggaggaaattcgaataattggttatatcaaagaaaatacttcaagaagacatggaccgtaatctcactcgatttacctgggcatgggaaatccgaagggatggaaattagttttaaagaatattcaaatgttttatatgagttatgtaatcatttaaagctaaaatcagtaacaatttgtggtctttcaaaaggagctagagtgggtatcgattttgctattcaatatccacgttttatttctagcttaattgttgtaaatgcatttccctatttagaaccggcagatcgtaaagaacgacttgaagtatatgatttacttagcttgcaggataaagggaaaacttgggctgatacgttattgagagcaatgggagtagaagataatgatgcaattgtccgaggatttcatcaatccctacaaatgattcatccgacgcatattcaaaggctattcgctgaattagttgattacgatcaaagaccatacctctctaacattgcatgtcctgcattaataatacgaggagagaatgattattttgttccggaaaagtatgtgagagaatttgaaaaacacctgagaaacgtgaccttcgttgagttgaaaaatagtgggcacttgccttatttagaacagcctactagctttaatgtgacggtagaggcatttttaaatcatgcgcttgattaa

SEQ ID NO: 402 - protein, 257 aa, Unknown
  Obtained from environmental sample
  DOMAIN (45)...(250): alpha/beta hydrolase fold
MYFEYKNRKIFYNIEGSGPVILFLHGLGGNSNNWLYQRKYFKKTWTVISLDLPGHGKSEGMEISFKEYSNVLYELCNHLKLKSVTICGLSKGARVGIDFAIQYPRFISSLIVVNAFPYLEPADRKERLEVYDLLSLQDKGKTWADTLLRAMGVEDNDAIVRGFHQSLQMIHPTHIQRLFAELVDYDQRPYLSNIACPALIIRGENDYFVPEKYVREFEKHLRNVTFVELKNSGHLPYLEQPTSFNVTVEAFLNHALD

SEQ ID NO: 403 - DNA, 921 bp, Unknown
  Obtained from environmental sample
atggacgttgttttagctttaggagctggtggggtaaaaggtttcgctcatatcggtgtgctgcgggtattagagcgacacgggttccgtatcagggctatcgcagggacgagcattggcggaattgtcggctcggtctactgtttgggtctcaacccggacgagatcgaaagcaagctgcgggtgatggaccaaaagaagttttacggccggatacccggagatggaccgtccattatgggggtatccgggttggtcgagatcttcaaagagatcttcggcgatatgaacctggagcaactgcgtctcccctttgcggttaatgccgtagatctggaaacagctgaagaagtcaatatcacccgcggaagaatcgtcgatgcgatcctggcgaccaccgcggtaccgggcatatttccacccagaaaggtgaacaaccagactctactggatggaggggttctcaaccccgtacctgtctcactggcgcgcgcactggccccagggctaccggttgtggcagtcgtgctatctccatcattacaaggctgggtagcccggccttcgccgcgcctgctgggaggattaccgcttatggggagctatatctcccagctgcgcccagcccaggccttggaaatcttcttccgctcggttgatatggccagctgcttaatggcagatctgcgcttggagaaggagcagccggaagtgattatccgaccggcgatcgatgggatcgggttgatcgacgaagtgaatgtggaggagatggtcaaaaaaggcgaaactgctgctgagctggccataccagagctacgatgggccgtcagttggcgagcgcgaataagccgccgcttcccctgggaaggtatgcggcgggctacgagccatcctgttcaaacgcacaatgggtcttga

SEQ ID NO: 404 - protein, 306 aa, Unknown
  Obtained from environmental sample
  DOMAIN (5)...(164): Patatin-like phospholipase
MDVVLALGAGGVKGFAHIGVLRVLERHGFRIRAIAGTSIGGIVGSVYCLGLNPDEIESKLRVMDQKKFYGRIPGDGPSIMGVSGLVEIFKEIFGDMNLEQLRLPFAVNAVDLETAEEVNITRGRIVDAILATTAVPGIFPPRKVNNQTLLDGGVLNPVPVSLARALAPGLPVVAVVLSPSLQGWVARPSPRLLGGLPLMGSYISQLRPAQALEIFFRSVDMASCLMADLRLEKEQPEVIIRPAIDGIGLIDEVNVEEMVKKGETAAELAIPELRWAVSWRARISRRFPWEGMRRATSHPVQTHNGS

SEQ ID NO: 405 - DNA, 939 bp, Unknown
  Obtained from environmental sample
gtgccgctcgatcccgtcatggacatggtgatccaacagatgtcccgacagggcgaggctctgtgggaactgcccatcgaggaagctcgacggcgggcggacgacggtctgctgaccctggtcgaccgcttcggcctcgaggagatggcccgggtggtcgagcgcgaggtgcccggtgaggcgggcccgatccgcgtacgcctctacgaccccggtggtcacggaccccgtgccgcgctggtgtacttccacgggggcgggtacgtgctgtgcagtctcgacacccacgatcagctgtgccggttcctcgcccgcttcgccgactgcatcgtggtgtcggtcgactaccggctggctcccgagcatccgtacccggccggggtgaacgatgcctgcgatgccaccgtgtgggtccaggaccacgccatggatctcgggatcgatccgacccgtgtggcagtcggcggtgacagcgcggggggcaacctcgcagccgtggtcgcgttgtggcaccgcgacgagggggaacgtcctccactgcgcacgcaggtgctcctctatcccggcgtcgaccgtcgcggtggctacgcgtcgctcgagaccaacggtgagggatacctcctgaccaccgagatgagggagtggttcgcgcgctgctacgtgcccgacgggatggatctcgccgactggcgcttgtcgccgatgtgcgctccgagccacgagggggtggcccccgcgatcgtggtcacggccgagtacgaccccttgcgcgacgagggcgacgcctacgccaggcgtctcgccgaccacgggatcgcggtccatcacatcaccgccgacggcatgatccacgggttcctgcagttcgctcccttccacgatggcgcccgggcggtcctccaacgggtcgccgacgagctcgcggcggccctggcgtga

SEQ ID NO: 406 - protein, 312 aa, Unknown
  Obtained from environmental sample
MPLDPVMDMVIQQMSRQGEALWELPIEEARRRADDGLLTLVDRFGLEEMARVVEREVPGEAGPIRVRLYDPGGHGPRAALVYFHGGGYVLCSLDTHDQLCRFLARFADCIVVSVDYRLAPEHPYPAGVNDACDATVWVQDHAMDLGIDPTRVAVGGDSAGGNLAAVVALWHRDEGERPPLRTQVLLYPGVDRRGGYASLETNGEGYLLTTEMREWFARCYVPDGMDLADWRLSPMCAPSHEGVAPAIVVTAEYDPLRDEGDAYARRLADHGIAVHHITADGMIHGFLQFAPFHDGARAVLQRVADELAAALA

SEQ ID NO: 407 - DNA, 387 bp, Unknown
  Obtained from environmental sample
atgcgcgtcggtcggctggtcgagggttcaggggtccgcctgtgggccgaggtgtgggggccgccggcggcggttccggtggtcctcgtccagcggatggcggctcaggggttcgagtggccgcggtcgctcgtctcggcgctcctcgacgcgggctaccgggtgctgacctacgaccaccgagggttcggttggtcgacggagggcccgctcgaccggcccttggccttcggcgagttggtcgaggatctgggcgcggttctggacggattcgggatggacgatgtccacctggtggggacctcggtcggtggggtgatcgcgcgttgcctggcgctcgatcggccgggtctggcccggagcctgaccttcatcggatccaaagaa

SEQ ID NO: 408 - protein, 129 aa, Unknown
  Obtained from environmental sample
MRVGRLVEGSGVRLWAEVWGPPAAVPVVLVQRMAAQGFEWPRSLVSALLDAGYRVLTYDHRGFGWSTEGPLDRPLAFGELVEDLGAVLDGFGMDDVHLVGTSVGGVIARCLALDRPGLARSLTFIGSKE

SEQ ID NO: 409 - DNA, 873 bp, Unknown
  Obtained from environmental sample
atgattatgattatgaacaagaactgtcgcccctgcatcacccctcggcctctcatccgcttggcccttctcgtactcatgctccccggtccggcatgcagtatcgccgagctagatacgacgcagcgccgcgaaaacggcctcgtcgtcatcctcccgggcatcgaaggaccgagctactggaaccataacctcgcgcggggcctggccgacggcggcgtccgaaacgccattcagatatatgactgggggacgaagattcccggcgggatgctcctcaacctgacggactacgagcgcaatcgagaaatggcggcttcgctgcgcgaccatatcgtcgcctatcgaagggagtatccgtcgcgcggcgttcaccttgtgggccactccggcggcgccggcattgcggtgatggcgacggagatgctgccggaaaacgagcgtgcgacaacggtgatcctcctcgccgcggcgctgagtccggagtatgacctgcagcccgcgctgagcaatgtttcgggtggaatttttaattactactcaaagctcgacgccgcgatgctcggggtcggcaccacggtggccgggacaatggatcggcgtcatacacaggcggctggcgcgatcgggttccgccggccggtgcgccagagcgaagcgggcagcgacccctaccgaaaactgcaccaggtggagtggagcccgaagatgcgaacatacggccacttcggggaccacatgggctggacccatcggtcctttgtccgccgctatctcgctcctttgatcgtggaattcaattcgtggccggcccacccgccgacggggatcgatgccccgcggcgttcgagcgaactgatcgccgagggctaa

SEQ ID NO: 410 - protein, 290 aa, Unknown
  Obtained from environmental sample
  SIGNAL (1)...(36)
MIMIMNKNCRPCITPRPLIRLALLVLMLPGPACSIAELDTTQRRENGLVVILPGIEGPSYWNHNLARGLADGGVRNAIQIYDWGTKIPGGMLLNLTDYERNREMAASLRDHIVAYRREYPSRGVHLVGHSGGAGIAVMATEMLPENERATTVILLAAALSPEYDLQPALSNVSGGIFNYYSKLDAAMLGVGTTVAGTMDRRHTQAAGAIGFRRPVRQSEAGSDPYRKLHQVEWSPKMRTYGHFGDHMGWTHRSFVRRYLAPLIVEFNSWPAHPPTGIDAPRRSSELIAEG

SEQ ID NO: 411 - DNA, 879 bp, Unknown
  Obtained from environmental sample
atgaggggcgggcaggggctgcagcgtctcgttccgatggttttttccgcctttctggccgcctgctcgccgctcgaagccttcaactcgctcgtcccgaaggaccgcggcggtgaaacggtgcagcgcggtgccgcgttcggtgcccatccgcgccagcgagtcgatgtctatcgtccgcgcgcgcgcagaggagcggtgcgcgagacgctgccgatcatcgtcttcctatacggcggctcgtggcagtcggggactcgcgaaggctatggctttgccggacgagcgctcgcagcgcgcggattcgtcgtcgccgtccccgattaccgcctcgtcccggaggttcgcttcccagccttcctagaggacaacgcggccgccttgcgctgggtgcgggccaatgcggcgcgcctgggcggcgatccggaccgcatcgtgctcgtcggccattcggcgggcgcgtacaatgcggcaatgctcgcgctcgacccgcgctggctgggaggggatcggcgcgcggtgcgcggcttcgtcggccttgccgggccctacgatttcctgccgctggccgggccggtgacaagagctgcgttcgggcaggagcgcgatcccgtgcagacgcagccgataagcttcgcctcgtcgggcgatccccccgccttgctcctccacggcgccaacgacacgacggtctatccgcgcaacagccagcgcctcgccgagcggctgcgcggcgccggcgtcgacgcgcgcgtaaagctctacccggagcttggccatatcggcatcgtcaccgcgctcgcgcggccgttccggggacgcgcttcggtgctcgacgatgttgccactttcgccaacgaagtgactgcgacgcgttag

SEQ ID NO: 412 - protein, 292 aa, Unknown
  Obtained from environmental sample
MRGGQGLQRLVPMVFSAFLAACSPLEAFNSLVPKDRGGETVQRGAAFGAHPRQRVDVYRPRARRGAVRETLPIIVFLYGGSWQSGTREGYGFAGRALAARGFVVAVPDYRLVPEVRFPAFLEDNAAALRWVRANAARLGGDPDRIVLVGHSAGAYNAAMLALDPRWLGGDRRAVRGFVGLAGPYDFLPLAGPVTRAAFGQERDPVQTQPISFASSGDPPALLLHGANDTTVYPRNSQRLAERLRGAGVDARVKLYPELGHIGIVTALARPFRGRASVLDDVATFANEVTATR

SEQ ID NO: 413 - DNA, 1005 bp, Unknown
  Obtained from environmental sample
atgcgaaagaagctggttcgtctgttggcgtggatcgccggcctttgcctgcttgggctggtgctgctggttgccgcgttctgggcgccgtcgcggtcggtggacgacctcaaggcgcgctgggcaacgccgccttccaccttcctggccatcgacggcatgcaggtgcacctgcgcgacgaagggccgcgcgacgacccggcacccttgctgctcctgcacggcacgtccgacagcctgcatacctgggagggctgggtgccgccgctggtgcaggcggggcaccgggtcatccgcgtggacctgccgggttttggcctgaccgggccgttccccgacggtgaccaccgcattgccgcgtacccgatattcctgtcacacctgctcgacgcgctggacgtgcgccgggtggtggtggcgggcaattccttcggtggccaggttgcgctggagctggcgctggccgagcccgatcgcgtcgagcggctggtgctggtggacgcgctggcctatccacgcaatgccaccaaggtgcccgtcgcgttcgtggtggcgtcggtgccgggcttgaaccggatcatggactacgtgctgccgcgttcgctggtcgaaggcagcgtgcgcagcgtatatggcgatccgtcgcgggtgacgccggcgctggtggaccgctactacgaactggccctgcgcgagggcaaccgaacggcgctgcgcaaccgcttcgccgggcttcccgacgaggcctacgcgcagcgcgtgaagcggctccgtttgccggtgctgctgctgtggggcgggcgcgaccagctcattcctattgcggcggccgaccgcttcctggccgacatcccgggcagccggctggtggcgttcccggacctgggccacgtgccgcaggaggaggacccgttggcttcggtggcgccggtgctggcgttccttcgtgaagccgacccggccgaacccggcgccagctcagcgcaggaagtgcagggccagtga

SEQ ID NO: 414 - protein, 334 aa, Unknown
  Obtained from environmental sample
  DOMAIN (95)...(313): alpha/beta hydrolase fold
MRKKLVRLLAWIAGLCLLGLVLLVAAFWAPSRSVDDLKARWATPPSTFLAIDGMQVHLRDEGPRDDPAPLLLLHGTSDSLHTWEGWVPPLVQAGHRVIRVDLPGFGLTGPFPDGDHRIAAYPIFLSHLLDALDVRRVVVAGNSFGGQVALELALAEPDRVERLVLVDALAYPRNATKVPVAFVVASVPGLNRIMDYVLPRSLVEGSVRSVYGDPSRVTPALVDRYYELALREGNRTALRNRFAGLPDEAYAQRVKRLRLPVLLLWGGRDQLIPIAAADRFLADIPGSRLVAFPDLGHVPQEEDPLASVAPVLAFLREADPAEPGASSAQEVQGQ

SEQ ID NO: 415 - DNA, 1014 bp, Unknown
  Obtained from environmental sample
atgaaaacaccggggtttctgcggtgtatcgctaccgctacgatagatggtacggaataccggggcctggctacggctggctttgatcctttaaaaattaaacctaccaccgacgtacccaaagattttataaatttttgggacaatgcaaaagcggccgctgctaaaatacccatggatgcccgcatgactttaatgccagatcgttgtaccgaaaccgtaaacgtgtaccacgtaagtctgcaaaactttgccctgaactcccggctttatggtattttatgtgttccgaaaaaagaaggtaaataccccgctattttaaaagtgcccggggcgggtgcccggccttacagcggggatgtagctgcagcagaaaaaggttttataacgttagatataggaatacatggcgtaccggttaccatggatgccagcgtttatggtaatttaatggcgggggccatcagcaattattggactcatggcttagacgataaagatcggtactattacaaacgggtttatatgggctgtatccgggcgaatgactttatttcaagtttaccccaattcgatggccagaacttggctgtaaccggcggtagtcaggggggagctttaagtattgtgaccgcggccttggactccagggtaaaatacctggtggcttattacccggcccttagcgatttaactggctacttacaccaaagagctgggggctggcctcatttatttgataaaaccaattacagctttaatggcaaaaaagataagatcgaaacttcgaaatattacgatgtggtaaattttgcccgcctggtaaaagtgcccggtttttattcctggggttataacgatgaaacctgcccgcctacctccatgtatgctgcctacaatgttattactgcccccaaagacttatttttggcccttgaaactggtcactggacttacccggaacagtatgaaaaaacaaatccctggctgtatggaaaattgcagggcaagtag

SEQ ID NO: 416 - protein, 337 aa, Unknown
  Obtained from environmental sample
  DOMAIN (27)...(333): Acetyl xylan esterase (AXE1)
MKTPGFLRCIATATIDGTEYRGLATAGFDPLKIKPTTDVPKDFINFWDNAKAAAAKIPMDARMTLMPDRCTETVNVYHVSLQNFALNSRLYGILCVPKKEGKYPAILKVPGAGARPYSGDVAAAEKGFITLDIGIHGVPVTMDASVYGNLMAGAISNYWTHGLDDKDRYYYKRVYMGCIRANDFISSLPQFDGQNLAVTGGSQGGALSIVTAALDSRVKYLVAYYPALSDLTGYLHQRAGGWPHLFDKTNYSFNGKKDKIETSKYYDVVNFARLVKVPGFYSWGYNDETCPPTSMYAAYNVITAPKDLFLALETGHWTYPEQYEKTNPWLYGKLQGK

SEQ ID NO: 417 - DNA, 879 bp, Unknown
  Obtained from environmental sample
atgaagaatgcgttgacgaactggctgtgccgcaaattgatcgactcaaaatgtgaaaaattcggcctgagcaaagccagcgtgaatacagtggatgggcgcactgtctactttaaaggtgggcaagggcccgatatggtattgctccatgggtttggcgccaataaagaaaactggctggccctggcgccccgtttaatgcgtcattacacggtatggattcccgacttgattggtttcggcgagtcagacaggccgttaaacgcccgtttttcgattggtgcgcagtctgagcgcgttattcattggctagacgcagtcgatgtcaaaagctttcatgtaataggcaactccatgggcgggtatttggcgggttttctggcagcaaactatgaacaaagagtgctcagcgcttgtctgcttaatccagccggtgtcaaaggtgctgaacacacagccattggacgggcattcgcagacgagggaaaggttattttggcccccagtaatttcgaagaatacgaacgtgtgatcaatttgtgtttcaacgacaaagcgcctccaatgcccaatttcatgcgcaaatatttcggacgcatgtcatttcagaacaaggcgctgctagaccgggtgtttatggaatttgtaaaccccgataacaacgtcagcttgaatgacatggtgagcagcaccaaggtccctttgatggtggtgtggggtgattcagatcaactggttcatccaagtgggctggctgttctcaaagaagccaaccctggcatcaaggacatcatgctggaaaacaccggccattgcccaatggtggacagggcgtccttggtctacaaggcacacttggcctttatgccagcaacttga

SEQ ID NO: 418 - protein, 292 aa, Unknown
  Obtained from environmental sample
  DOMAIN (70)...(287): alpha/beta hydrolase fold
MKNALTNWLCRKLIDSKCEKFGLSKASVNTVDGRTVYFKGGQGPDMVLLHGFGANKENWLALAPRLMRHYTVWIPDLIGFGESDRPLNARFSIGAQSERVIHWLDAVDVKSFHVIGNSMGGYLAGFLAANYEQRVLSACLLNPAGVKGAEHTAIGRAFADEGKVILAPSNFEEYERVINLCFNDKAPPMPNFMRKYFGRMSFQNKALLDRVFMEFVNPDNNVSLNDMVSSTKVPLMVVWGDSDQLVHPSGLAVLKEANPGIKDIMLENTGHCPMVDRASLVYKAHLAFMPAT

SEQ ID NO: 419 - DNA, 1275 bp, Unknown
  Obtained from environmental sample
atgaataagacggtctttgcctggttgtttctacttttgatttttacttcctttacaacacctgcaccgggccctcaataccgcaaagcgccaacgttgattaataacatggtaaaggcacgtattgatgccagcctgaaaagttttgttgattctggcaaagtagcaggtgtttcggctttaatcttcgaaaaaaacaaagaagtatattataatgctttcggccatgccgaccgggagactaaaacacccatggaccggaataccatcgtccggatttactccatgacaaagcccgtaaccggcgttgcgctgatgcaattatatgagaaaaacctttttcagctggatgatcccttagctaagtacgccccggaatttgcccaaatgaaggtgtttaaaggaatagatacttccggcaatttaatcctggaacccgcaaaacgccctattaccattcgcgacctgactcgccatacggccggttttgccaccagctcagatcttccggccggactggctgaattggttaaaaagattgatgctatgaatccggctaacactttgaggcagatggtcctaaaattagccaatcagccgctgctgtttcaccccggtgagcaatgggcttacggcccatcggtggatgtgcaggcctatctagtagagcaaatttccggcaaacccttcgaccagtacctgcaggaaaatatatttaaaccgttaggcatgacccacacccggtatattgttccggcaggcgactgggcaaaattagccggtatgtatcggaacagcccaaatggtccattaacccgcgtacccgatgatgaaaattcgtataatatcaaagactggcctttgaaaacgggtggctatggccttacctctaccctggatgattacatgaagtttgcacaaatgctggtaaataaaggcaaatggggcaaagctttaattctaaaacccaaaaccgtaaggttaatggctaccaaccacctgtcagaagatatcaccgagcggatgtggctgcccagcaaaggccaggtaggctttggtatagactttgccgtgcgtcttcgggctccggctactcccgaagaaaacaacggggtggtaggtgagtttttctgggatggagccgccagtaccttgttttgggttgatccggtgcatgaaattacggccgtattgtttgtacaaataatgcctttttctggcaaactgcacaagagtttccgggatgccgtttacggcgagtataaacctcaataa

SEQ ID NO: 420 - protein, 424 aa, Unknown
  Obtained from environmental sample
  SIGNAL (1)...(19)
  DOMAIN (42)...(419): Beta-lactamase
MNKTVFAWLFLLLIFTSFTTPAPGPQYRKAPTLINNMVKARIDASLKSFVDSGKVAGVSALIFEKNKEVYYNAFGHADRETKTPMDRNTIVRIYSMTKPVTGVALMQLYEKNLFQLDDPLAKYAPEFAQMKVFKGIDTSGNLILEPAKRPITIRDLTRHTAGFATSSDLPAGLAELVKKIDAMNPANTLRQMVLKLANQPLLFHPGEQWAYGPSVDVQAYLVEQISGKPFDQYLQENIFKPLGMTHTRYIVPAGDWAKLAGMYRNSPNGPLTRVPDDENSYNIKDWPLKTGGYGLTSTLDDYMKFAQMLVNKGKWGKALILKPKTVRLMATNHLSEDITERMWLPSKGQVGFGIDFAVRLRAPATPEENNGVVGEFFWDGAASTLFWVDPVHEITAVLFVQIMPFSGKLHKSFRDAVYGEYKPQ

SEQ ID NO: 421 - DNA, 1215 bp, Unknown
  Obtained from environmental sample
atgaacttcaaaaaaacactgttggcgctggctttagtcttggctgacagtaccgcagcagccagcaataacgaccccattgtgctagtgcatggcttcgccggttgggatcgcgacgagctatggggcctttacccgcactggggcggcactaccgacctgcaagaggaattgaagaagaacggccatgacacggttaccgccgccgtcgggcccttcagctccacctgggatagagccgccgagctttactaccagctcaagggtggctgcgtggactatggcgcggcgcatgccgcccaacacggccatgcccggatcggccgctgctataacggcaaccagccatatgtagatgccaaacgcctgccccaatgggataccagccacaagatccatctgatcgcacacagccagggcgcgcccaccgtgaacatgctggtggaactgctgcgcaatggctcagtggccgagcgggctgccagcggcagtacggtgggcgagctctatctgggcggcaaggattgggtgcgttccattaccaccgtggcaggtgccaacaatggcaccacctttggcaagttgaccggcttcaatgaatttgccaaacagttgctgaaagccgtgggcgccattgccggtttaggcggcaatccggaagacctgccttacgatttcaagctagaccagtggggcttgaagaaaggcagtaacgagacccagcaacagtattgggatcgcgtctgggcgtcgccaatctggcatagccaggatgtgggtctctataccctcagcccagaaggcgcagcggcggagcggacttgggtcaagacttcccccaacgtttactatttttcctacaccaacggcaccaccctgcccggcctgatcaccggcaaccactacgccgacccaaccaccaatctgccgctggtgccgtttgccaatggcatgggcgcttatcgggcttatggtgacaactggcgacagaacgatggcgtggtaaataccatcagcatgaaagcgccgtttggtgcgccggtggtggaatacaacggcaacccccaaaagggcaaatggaaccacatgggtttcagccagcaggatcactgggaagtgatcggcagcggcgacgtggccggtaatctgttctacaactggcggctggtcagcttctacgtcaatcaagccaatctgctaaagcagctggattga

SEQ ID NO: 422 - protein, 404 aa, Unknown
  Obtained from environmental sample
  SIGNAL (1)...(22)
MNFKKTLLALALVLADSTAAASNNDPIVLVHGFAGWDRDELWGLYPHWGGTTDLQEELKKNGHDTVTAAVGPFSSTWDRAAELYYQLKGGCVDYGAAHAAQHGHARIGRCYNGNQPYVDAKRLPQWDTSHKIHLIAHSQGAPTVNMLVELLRNGSVAERAASGSTVGELYLGGKDWVRSITTVAGANNGTTFGKLTGFNEFAKQLLKAVGAIAGLGGNPEDLPYDFKLDQWGLKKGSNETQQQYWDRVWASPIWHSQDVGLYTLSPEGAAAERTWVKTSPNVYYFSYTNGTTLPGLITGNHYADPTTNLPLVPFANGMGAYRAYGDNWRQNDGVVNTISMKAPFGAPVVEYNGNPQKGKWNHMGFSQQDHWEVIGSGDVAGNLFYNWRLVSFYVNQANLLKQLD

SEQ ID NO: 423 - DNA, 1851 bp, Unknown
  Obtained from environmental sample
atggcagtgtttgactacaaggatgtgggttccagcgcatctacggcacttttcaaggatgcaatggcaatcacgctttacagctatcacaacctcgacaacggttttgccgtgggttaccagcaacacggtctcggcacaggtttgcctgccacactggtcaaggccgtactgggcggcaccgattctcagggggtagtgccggggattccctggaacccggactcggagaaacttgcccgtgaagcggtggaaaaagccgggtggacccccatcagcgccgagcaattgggatacgcgggcaaggtcgatcagcgtgggacatttttcggcgaaaaggcaggttatggcagcgcccaagtggaaatcctcggtaaatacgccgccgatggtcatttgacgtctatcggtatcggttttcgtggcaccagcgggccgcgtgagtcgttgattacggactccatcggcgatgcaatcagcgatttactagcggccatcgggcctgcggactacgccaaaaactacagcgccaacgcctttgacgcgctgctcggcaaagtggctgcctttgccagtgctcaagggttgaacggcaaggatgtgctggtcagcggccatagcctgggtggtctggcagtcaatagcctggcagacctgagtggcgatcactggtcggggttttatcgggatgccaagtacatcgcgtttgcgtcacccacacaaagcgaaaccacgtccaatgtgttgaatatcggttacgaaaacgacccggtgttccgcgccctggatggctcggatttcaatctttcgtcgttgggtgtgcatgatgcgtatcagccgtccgccaccaacaatattgtcagtttcaacgatcactacgcttccaccgcgtggaacctgatgcccttttcaattgccaatatctcgacctggatcactcacttgcccagtggctatgaaagcgggatgacgcggattctcgactcggcgttttatgacctgacccacaaggactcgaccattgtggtcgccaatttgtccaacccgacgcgagaaaacacctgggttcaggacctcaatcgcaatgctgaaccccataagggcagcacttttatcattggcagcgacggcaacgatttgattcagggtggccgcggcaacgacttcctggaagggcgcgacggtaatgacaccttccgcgacagtggcggctacaacatcattctgggtggcaagggcgtcaacaccctggacctgcagcaatcgttgagtcgtgtggatgtggtcaatgatgggcagggcagcctgtatgttcgcgatgcccacggcgggatcagtattgcccgtgacatcagctttttaataaccgaagagcccgcctggctagggttgagccaccacgaggttaaccatcgggtggccgatgatggcttgtggtccggcaaagaccgcactgactacacccactcgatcaaggccgaaccgggcgacagcacgctcaaggcggttgaacagggcgattggctgctggggcagggcggtaacgatcatttgatcggtttgcagggcaacaatgtgtttattggtggtgccggcaatgacctgctggaggccgctggcggcaacaatacgttcgttttcagcgggcactttggcaacgacacgctgctgggctatcagcccaccgacacgttggtgtttttgggggttgagggtggccacgtcgccgactaccgggcccatgccagtgcatcagggcatgacacggtgctcagcttcggcagcgactcggtaactctggtcggtgtcgggctggcctccctggcgggcacggatattgtgattgcctga

SEQ ID NO: 424 - protein, 616 aa, Unknown
  Obtained from environmental sample
  DOMAIN (133)...(267): Lipase (class 3)
MAVFDYKDVGSSASTALFKDAMAITLYSYHNLDNGFAVGYQQHGLGTGLPATLVKAVLGGTDSQGVVPGIPWNPDSEKLAREAVEKAGWTPISAEQLGYAGKVDQRGTFFGEKAGYGSAQVEILGKYAADGHLTSIGIGFRGTSGPRESLITDSIGDAISDLLAAIGPADYAKNYSANAFDALLGKVAAFASAQGLNGKDVLVSGHSLGGLAVNSLADLSGDHWSGFYRDAKYIAFASPTQSETTSNVLNIGYENDPVFRALDGSDFNLSSLGVHDAYQPSATNNIVSFNDHYASTAWNLMPFSIANISTWITHLPSGYESGMTRILDSAFYDLTHKDSTIVVANLSNPTRENTWVQDLNRNAEPHKGSTFIIGSDGNDLIQGGRGNDFLEGRDGNDTFRDSGGYNIILGGKGVNTLDLQQSLSRVDVVNDGQGSLYVRDAHGGISIARDISFLITEEPAWLGLSHHEVNHRVADDGLWSGKDRTDYTHSIKAEPGDSTLKAVEQGDWLLGQGGNDHLIGLQGNNVFIGGAGNDLLEAAGGNNTFVFSGHFGNDTLLGYQPTDTLVFLGVEGGHVADYRAHASASGHDTVLSFGSDSVTLVGVGLASLAGTDIVIA

SEQ ID NO: 425 - DNA, 759 bp, Unknown
  Obtained from environmental sample
atgcgaggacttcgtgttctagtggccgcggtcgtgctggccacgacggtcttggtggcctggccgggctcgagcgcctcggccgcggccaagaacccggtggtggtcgtggcggggctctcgggccccggcatcgcctacgaaccgcttgcggcccggctgcgtagcgacggctaccaggcgttcgtctaccagcttcccggcctcggcttcggcgacatccaccagagcgcagctgcgctgtgcggctacgtcgaccaggtgcgagcccagaccggtgcggcgaaggtcgacctcgtcggtcactcggaggggggcctcgtctcgcgtgactgcgtcaagagcttcggcggtgcgcagaaggtcgacaaggtcatcaccctcgggacgccgaactacggaaccgtcgcggcgaacatcgcgaccttcttcacactcggaacctgcatcggcatcaccgcgtgcgtgcagatgacgaccggttcgacgttcctcaacacgctgaacgcgggcgacgacagcatcggcagcgtgcgctactggaactacgccacgaagctcgacgagctcgtgcagccctatcgcaactccttcctcaccgcgagtgacgggaacatcgtgaacgtcgcgatccaggaccagtgctggcttcgcgtggttggccacctgggcctgatcctcgacggcaccacctacagcggggtcaagcaggccctcgagggcgacaccacgccgcggttgaactgcttcgcgctctga

SEQ ID NO: 426 - protein, 252 aa, Unknown
  Obtained from environmental sample
  DOMAIN (31)...(225): Lipase (class 2)
MRGLRVLVAAVVLATTVLVAWPGSSASAAAKNPVVVVAGLSGPGIAYEPLAARLRSDGYQAFVYQLPGLGFGDIHQSAAALCGYVDQVRAQTGAAKVDLVGHSEGGLVSRDCVKSFGGAQKVDKVITLGTPNYGTVAANIATFFTLGTCIGITACVQMTTGSTFLNTLNAGDDSIGSVRYWNYATKLDELVQPYRNSFLTASDGNIVNVAIQDQCWLRVVGHLGLILDGTTYSGVKQALEGDTTPRLNCFAL

SEQ ID NO: 427 - DNA, 942 bp, Unknown
  Obtained from environmental sample
atgcagattcaccccgaaatggctgccgtgctggagcagttcaaggatgctccgcccatggattttgtggccactccggtccccgaaatccgcaagctcatggaccacatggccttcccgcctgccgacctgcccatgcatgaggtgcgtgagatcgacatccccgggggtgacggccagccgctcaagctgcgtctgtaccgtcccagcaccgcgcaggcagcgccggtcatggtctattttcacggtggtggctggtgcataggcacgctggaaacgcatgacaacctgtgccgccacctggcgcgcctgactggcatgaatcttgtgtcggtcgattaccgtctggctcccgagcatgtctttcccgccgcgctggacgacgcctatgccgccactcgctgggtggcgcagcatgcggccgagctgcattgcgatgcgcagcaactgatggtggcgggggacagcgcggggggcaatctggccattgccacctgcctgcgggcaaaagaagacggctggaaaggcatagcccagcaactgctgctctatccggtctgcgatgcgcatatggatgcgccatcgtatgcgctttatgggcagatgccgtttctcaccaccgaagccatggccgcgatgtggcgtcactatcaccccgccatgcctgcacacccgctggcttccatcatgcagtaccccgatctcgctggtttgccagcagcggtgctggtgactgcggaactggacatattgcgcgacgaaggagaggcctttggcctgcgcctgcatcaggccggagtgccggtggcctgcctgcgggctcaaggcatgttgcatgggtttgcaaatttcagcaccctggtgccggcggtggcaagcttgctcgaagaggcttgtgcagagctccaccaggtcaagtccttggggcttgctcagccttga

SEQ ID NO: 428 - protein, 313 aa, Unknown
  Obtained from environmental sample
MQIHPEMAAVLEQFKDAPPMDFVATPVPEIRKLMDHMAFPPADLPMHEVREIDIPGGDGQPLKLRLYRPSTAQAAPVMVYFHGGGWCIGTLETHDNLCRHLARLTGMNLVSVDYRLAPEHVFPAALDDAYAATRWVAQHAAELHCDAQQLMVAGDSAGGNLAIATCLRAKEDGWKGIAQQLLLYPVCDAHMDAPSYALYGQMPFLTTEAMAAMWRHYHPAMPAHPLASIMQYPDLAGLPAAVLVTAELDILRDEGEAFGLRLHQAGVPVACLRAQGMLHGFANFSTLVPAVASLLEEACAELHQVKSLGLAQP

SEQ ID NO: 429 - DNA, 1032 bp, Unknown
  Obtained from environmental sample
atgagcaaattcgcaatactctgggcgttgataacggcatacctgccggaacctgtgatgaaactggtatatttagggcggcgcgaaacgcttggggcacggacgcttgacgttaaagcccaagctgtcgggcggctggccaatgcaacaagacctgtcggggtgattccgacggtcgaggaaagccggaagatgacggataaagccgttagcctttttgatcagcccgcccccgaattattccgtaaaaaagacattcagattgacggggctgaagggcctattgatgcccgtatttacagcggccctgcaaaacatcgcccgcgaccaattctagtgtattttcacggcggtggctgggttcagggcaatctagacagccatgacggggtttgcggcaagctggcaaaatgggcgaactgcatcgttatctcggtcgattatcgtctagcgcccgaacacaaattcccaagtgcgccgcttgatgcgattgcggcctataaatgggtgtgcgccaacgcaacaaaccttggcggcgatcctgaacgtatcggggttggcggggacagtgcggggggtaatcttgccgccgttgtctgccagcaaaccgccatgaacggcgagcgcacaccagatctgcaagtcctgatctatccggcgctggatgcacgcatgatctcgacctcgatggaggaattgcgtgatgcctacatcctgccgaaatccagaatggagtatttcctcggcctatatacgcgtggccctgacgatatcgaggaccttaggatgtcgccaattctcagggataccgtcgcggatcaaccccaagcctgcattgtcacctgtgggtttgacccgctgcgcgacgacgggaacacctacgccgaacgcttaattgccgaggggatagacgttaaacatattcagtattccggccaaattcatgcatttgtaaatctgtgcaaagtaattccgcagggtaacgcatgtattcaggatatcgctaattggctgaaaaccgtctggcggtaa

SEQ ID NO: 430 - protein, 343 aa, Unknown
  Obtained from environmental sample
MSKFAILWALITAYLPEPVMKLVYLGRRETLGARTLDVKAQAVGRLANATRPVGVIPTVEESRKMTDKAVSLFDQPAPELFRKKDIQIDGAEGPIDARIYSGPAKHRPRPILVYFHGGGWVQGNLDSHDGVCGKLAKWANCIVISVDYRLAPEHKFPSAPLDAIAAYKWVCANATNLGGDPERIGVGGDSAGGNLAAVVCQQTAMNGERTPDLQVLIYPALDARMISTSMEELRDAYILPKSRMEYFLGLYTRGPDDIEDLRMSPILRDTVADQPQACIVTCGFDPLRDDGNTYAERLIAEGIDVKHIQYSGQIHAFVNLCKVIPQGNACIQDIANWLKTVWR

SEQ ID NO: 431 - DNA, 672 bp, Unknown
  Obtained from environmental sample
atggagtacgcgttgtacgtgcccaagagctatgacggcacaaagagtcttccactgatcgtcgccttgcacggactgttcagcactccgcgacaaattctgagctatccgggctttacgcggcatgccgaccagcatggctacttacttgtcgcgcccatgggatacaacacgcgcggctggtatggcagtcgcggcaaaggaggcggtggcggcaccgacccggaaaacctgggcgagctgagcgagaaggacgtcatgaacgtcttggaacgggtccgcgagcagttcaagatcgacgacaatcgcatctttctcttggggcactcgatgggtggcggcggcgcgttgcacttggcgatacagcaccccgacatctgggccgcaattgcgccgatcgctcccgccgtaccacgcgatgccgctgagctggaacgggccaagcacattccggcgatcgtcgtgcaaggagaccaggatgggctcgtacacggcactcggcgttgggtcgagaaaatgaaagaactcggtatggaacatcgatacatcgaggtcaaaggcggcggccacatcttcgtcgcctttcagcacttcgacgagattttcggcttcttcaacgctcatcccaaagataaacgggaaatggcgaaacccgcggactccgcgcaatag

SEQ ID NO: 432 - protein, 223 aa, Unknown
  Obtained from environmental sample
  DOMAIN (1)...(205): Putative esterase
MEYALYVPKSYDGTKSLPLIVALHGLFSTPRQILSYPGFTRHADQHGYLLVAPMGYNTRGWYGSRGKGGGGGTDPENLGELSEKDVMNVLERVREQFKIDDNRIFLLGHSMGGGGALHLAIQHPDIWAAIAPIAPAVPRDAAELERAKHIPAIVVQGDQDGLVHGTRRWVEKMKELGMEHRYIEVKGGGHIFVAFQHFDEIFGFFNAHPKDKREMAKPADSAQ

SEQ ID NO: 433 - DNA, 750 bp, Unknown
  Obtained from environmental sample
atgagagttgtacaacccaaaccttttacttttgaaaaaggtccgcgggccgttttattattgcatggttttacggggcattctgccgatgtacggatgctcggacgctttttggaagaaagaaactatacatgccatgcaccaatctatcgtggacatggtgttgcaccagaggaattaataaagacaaaccccaatcagtggtgggaagacgttgaggaagcgtttaaccatttaaaagaacgcggttatgaggaaattgcagtagcgggtctttcacttggaggggtttttagtttgaaacttgcttatacgagacctgtaaaagcagttattcccatgagtacaccgatgtttttcgacaatgaagaacaattaacaaatggatttcattactttacaagacaatataaaaggttagaaggaaaatcaaaagaggaagtcgaggaggaaacaagagcggtcatggaagattccggaacgatattcaatcaggtggctgattacattgctgatgtgaggtcccatgtggatttaatttatacgccggcgatggtcgttcaggcgggaaaagatcaaatgatcaataaggacagtgcaacttatatctacgaacacctggaatcagataaaaaagaaataaaatggtatgaggaatcaggacatgtcattacgatcgataaagaaaaggaacagctttttgaagatatctatcaatttttagagtctttagattggaaatcatcgtaa

SEQ ID NO: 434 - protein, 249 aa, Unknown
  Obtained from environmental sample
MRVVQPKPFTFEKGPRAVLLLHGFTGHSADVRMLGRFLEERNYTCHAPIYRGHGVAPEELIKTNPNQWWEDVEEAFNHLKERGYEEIAVAGLSLGGVFSLKLAYTRPVKAVIPMSTPMFFDNEEQLTNGFHYFTRQYKRLEGKSKEEVEEETRAVMEDSGTIFNQVADYIADVRSHVDLIYTPAMVVQAGKDQMINKDSATYIYEHLESDKKEIKWYEESGHVITIDKEKEQLFEDIYQFLESLDWKSS

SEQ ID NO: 435 - DNA, 957 bp, Unknown
  Obtained from environmental sample
atgaaccccatcgaccgcagccgcagcctgttcacccaggccactggcgccgcccggcagaccgctgagacgaccctcaagaaccccctcgggaaggtcgtcgacctggccaagggtgggctggcggacctgcctcgcaacctgcagatgggcctggacgtgttccagtccgcccacctcaacgagctgaagaagctgttcggcgatggcagcgccaagccggaccgcatgtatgacgggcagttcgtgggcacccagggccagacgttcccgcctggcaccccgctggcgatgattccgggcgtcactccgaagaacaaccccaacccctcggagaccatcctctacgtcaacggcatcatgacgcccaaggagggccagctcagcgagatgcagtccatcgccgacacgtccggggcgaaggtggttggcatccacaactccacccagggcctggtggccgacctggcccagtgcgtgggcgacaagctggacaagggcagcaaccccgccgtggacacgctggccgacacgctctactcggagctgaaggcgggccgctcggtgcacctgatgggctacagccagggcggcctcatcaccgcccgcgcgctgttcgacgtcgagaaccggctgcgcatcgaggacgggatgtccaagacgcaggtggagcaggcgatgagcaagctcaaggtggagaccttcggggccgcctcgacgcgctacccagacggcccgcagtacgtgcactacgtcaacaacgccgacgcggtgcccaccctcaccggcctgggcggcagcgtggacccggccgccttcctgaaggacgcgggcaagggcgccgtggtgcaccgcttcaccgacggcaacctcaaccccatcagcaaccacatgctggacaccatgtacatgaagcaccgggtgcccttcgagcaggcgcgcgagaaccgcttctaa

SEQ ID NO: 436 - protein, 318 aa, Unknown
  Obtained from environmental sample
MNPIDRSRSLFTQATGAARQTAETTLKNPLGKVVDLAKGGLADLPRNLQMGLDVFQSAHLNELKKLFGDGSAKPDRMYDGQFVGTQGQTFPPGTPLAMIPGVTPKNNPNPSETILYVNGIMTPKEGQLSEMQSIADTSGAKVVGIHNSTQGLVADLAQCVGDKLDKGSNPAVDTLADTLYSELKAGRSVHLMGYSQGGLITARALFDVENRLRIEDGMSKTQVEQAMSKLKVETFGAASTRYPDGPQYVHYVNNADAVPTLTGLGGSVDPAAFLKDAGKGAVVHRFTDGNLNPISNHMLDTMYMKHRVPFEQARENRF

SEQ ID NO: 437 - DNA, 2082 bp, Unknown
  Obtained from environmental sample
  misc_feature (1867)...(1869): n = A,T,C or G
atgtgcacagctacgcacgacgagcggtcgttcgtggcggcgctggagagtgacgtgccgttcgacgtcatccttgccgactacaagctcccgcagttcaacaagctcccgcagttcgatggtgaacgggcccggcagttggcggccgccgcccggccggacgtgccggtcgtgttcgtcagcgtggcgctcggggacggactggcggcggcggccgtgcgcgacgggatggccgactacgtgggcaaggcgcatctcggcgcgctgcccgcggcggtgaggcgggccgtgcgggccggccgcgagcgggcccgccggcgggaggtcgagcgggcggcggcgacgaccgcggcgcagttccggtcgctcgtcgagcacgtccgcgggacggccatctacctgatcgacaacgacggcgtcatccggtcgtggaaccgtggggccgaggcgatgaaggggttcaccgccgacgaggcgatcgggatgccgttcgagcagttgttcctccccgccgaccgggcggccggggagccgcggcggcagttggagatcgcggccgctaagggggagtaccgcagcaccggccgccggcggcggaaggacggcccgccgttcgacgccgagctcgtgctgactgcgctccgcgaccccggcggttcgccccgcgggttcctcaagatcgtccacgacgtgaccgaccgactccggcgcgagcgggagcgggaggagctgctggcggccgagcaggcggcgcgggcgcgggccgaggcgatggccgaggaggcccgggcgtcggccgaggaggccgagcgggccgggcggatgaaggacgagttcctggcgacgctcgggcacgagctgcggacgccgttgaacgcgatcctcgggtgggcgcaggtgctgagccgcggcggcgccgtcggcccggacgccgccgccgggctcgccgcgatcgagcggaacgcccgggcgcaggcccagatcatcgaggacctgctggacatgagccggatcatctccgggaaggtccggctcgacgtccgcccggcggacgtgtcggcagcggtgcgggcggcggccgacacctgccgccccgccgccgacgccaagggcgtccggctcaacgccgtcatcgacccgggccccggcctcgtcagcggcgacccggaccggctccagcaggtgttctggaacctgctcagcaacgcggtgaagttcacgccccgcggcggctgcgtgcaggtcgtcgtcgggcgggtcgactcgcacgtggaggtcgcgatctccgataccggcgagggcatccgcgccgagttcctcccgcacgtgttcgaccggttccgccaggcggacgggtcgaccacgcggcggcacggcgggctggggctggggctgtcgatcgtcaagaacctggtcgagctgcacggcgggtcggtccgggccgagagcgccgggcacggcaccggcgcgacgttcgtcgtcagcctgccgctggccgccgtccgccccgccccgtcggtcggtcccgacggcgacggcgagctggcgcggccgtccactgtccatgcccggctgccggggatggccgagctgtccgaccggctcgccggcgtgcgcgtggtcgtggtggacgacgagcccgacgcccgggcgctgctgcggcgggtgctggaggactgcggcgcggtggtgtcggcggccgggtcggcggccgaggcgctggcgtgcgtgacggccgatccgccggacgtgctggtcagcgacatcggcatgccggacgaggacgggtacgccctgattggaaaggtccggtcgctcgcgccgggggcgggcggggacgggtacgccctgattggaaaggtccggnnncccttcgtgggcgatcctcaggccttgtccgccgccagcagcttcaccgccgcgtccttgactcgggcgtggtccttctcctccacgttcgtcagcagcggcgccagcggccccgtgttggcgatgccggccagccgcaccgcctcgtgcagcacccggatcgggttgatgttgttccgcaggtcctcgagcgggaagaagatctggcggatc

SEQ ID NO: 438 - protein, 694 aa, Unknown
  Obtained from environmental sample
  DOMAIN (538)...(640): Response regulator receiver domain
  DOMAIN (387)...(499): Histidine kinase-, DNA gyrase B-, and HSP90-like ATPase
  DOMAIN (275)...(341): His Kinase A (phosphoacceptor) domain
  DOMAIN (192)...(234): PAC motif
  DOMAIN (118)...(181): PAS domain
  VARIANT (623): Xaa = Any Amino Acid
MCTATHDERSFVAALESDVPFDVILADYKLPQFNKLPQFDGERARQLAAAARPDVPVVFVSVALGDGLAAAAVRDGMADYVGKAHLGALPAAVRRAVRAGRERARRREVERAAATTAAQFRSLVEHVRGTAIYLIDNDGVIRSWNRGAEAMKGFTADEAIGMPFEQLFLPADRAAGEPRRQLEIAAAKGEYRSTGRRRRKDGPPFDAELVLTALRDPGGSPRGFLKIVHDVTDRLRREREREELLAAEQAARARAEAMAEEARASAEEAERAGRMKDEFLATLGHELRTPLNAILGWAQVLSRGGAVGPDAAAGLAAIERNARAQAQIIEDLLDMSRIISGKVRLDVRPADVSAAVRAAADTCRPAADAKGVRLNAVIDPGPGLVSGDPDRLQQVFWNLLSNAVKFTPRGGCVQVVVGRVDSHVEVAISDTGEGIRAEFLPHVFDRFRQADGSTTRRHGGLGLGLSIVKNLVELHGGSVRAESAGHGTGATFVVSLPLAAVRPAPSVGPDGDGELARPSTVHARLPGMAELSDRLAGVRVVVVDDEPDARALLRRVLEDCGAVVSAAGSAAEALACVTADPPDVLVSDIGMPDEDGYALIGKVRSLAPGAGGDGYALIGKVRXPFVGDPQALSAASSFTAASLTRAWSFSSTFVSSGASGPVLAMPASRTASCSTRIGLMLFRRSSSGKKIWRI

SEQ ID NO: 439 - DNA, 918 bp, Unknown
  Obtained from environmental sample
atgcagcgtattgctgatcagatgaaacgtgcaggtcataaacccatgtatgagctttcaccgcagcaggcgcgggaatactatgagcgcaatgccagtattttggatttgccagcagcatcgttgccgcgtgtagagaatttttatattccatcaacagatggcgagttattgccggccagattgtatgcaccgtcagaagagaagggcttgcctgttctcttgttttttcatgggggtgggtttaccgttggcagtattgacacgcacgatagtctgtgccgccagcttgcgttgctcagtggtgttgccgtggtgtcgctggattaccggctggcaccggaatataaattcccggttgcagtggatgacgcatgggcggcctgccagtggctgaaccagaatgggcagactctggggctggatggtttccggctggctgtcgggggcgatagtgccgggggaaccttggccgccgtgtgtgccattatggcacgcgatgcgcagttgcctgtggcattgcaggtgctgttttacccgggcactacagcacaccaggataccgagtcgcacacggtgtatgccgataacgcgattattcctgaagtgctgattacctggttcttccaccagtatattgaagatgggcagcgtgaagactggcgctttgcaccgctgttgtgtgacgacttgcaaggtgttgcacccgcctggatgggactggcggaatgtgacccgttggtggatgaaggtgtcgcatatgctgaccggctgcgttttgccggagtgccggtggaactggagctctataaaggtgtgacgcacgagtttgccaaattcgggcaggcgataccggaagccctggcagcccagaaagctgcggcacaggcattggcacaggtatttgatgtggtttaa

SEQ ID NO: 440 - protein, 305 aa, Unknown
  Obtained from environmental sample
MQRIADQMKRAGHKPMYELSPQQAREYYERNASILDLPAASLPRVENFYIPSTDGELLPARLYAPSEEKGLPVLLFFHGGGFTVGSIDTHDSLCRQLALLSGVAVVSLDYRLAPEYKFPVAVDDAWAACQWLNQNGQTLGLDGFRLAVGGDSAGGTLAAVCAIMARDAQLPVALQVLFYPGTTAHQDTESHTVYADNAIIPEVLITWFFHQYIEDGQREDWRFAPLLCDDLQGVAPAWMGLAECDPLVDEGVAYADRLRFAGVPVELELYKGVTHEFAKFGQAIPEALAAQKAAAQALAQVFDVV

SEQ ID NO: 441 - DNA, 639 bp, Unknown
  Obtained from environmental sample
atgaaaaaagtctattttataagcggccttggtgcagataaaagagcattttcatttcttgatttatcgttttgcgaccccatttttattgaatggataaaaccattaaagaacgaatctcttcagggatatgcattacgacttaaagagcaaataaaagagcctggtgcagttatcattggcgtttcttttggtggaatgcttgccacggaaattgcaaaaactgacttcgctacgaaagttattatcatctcaagtaataaaattaaaaaagagtttcctaaaattttcctgaccggaaaatacctgccggtttataaatggctcccctcagccttattaaaaaaaggaacaattatccgcagcaagttctttagtccaaaaggagaaatgcagaagaaaatttttcagcagatattaaatgatactgacacaaaatttacaaaatgggcaatttattcaattcttcattggcaaaacgaagtaatccccgataacgtaattcacattcatggcacatcagacaatttactcccctatcgtttagtaaaagcagattacaccataaaaaatggcacacacctgatgataatgaaccagtataaagaaatttcggaactgctgaaaaaactaatctaa

SEQ ID NO: 442 - protein, 212 aa, Unknown
  Obtained from environmental sample
MKKVYFISGLGADKRAFSFLDLSFCDPIFIEWIKPLKNESLQGYALRLKEQIKEPGAVIIGVSFGGMLATEIAKTDFATKVIIISSNKIKKEFPKIFLTGKYLPVYKWLPSALLKKGTIIRSKFFSPKGEMQKKIFQQILNDTDTKFTKWAIYSILHWQNEVIPDNVIHIHGTSDNLLPYRLVKADYTIKNGTHLMIMNQYKEISELLKKLI

SEQ ID NO: 443 - DNA, 1014 bp, Unknown
  Obtained from environmental sample
gtgacttctcctgatcgctctgccctgcgaccagagatcaccgagttcctcgaagagcttgacgcggctggcggaagtttcgccgagctggctcccgatgaggtgcgtccggtagtcgaggagctgtgccgccagttgtggggcgagagagtcgctgttctaaccgttgccgacatcgaggttcctggatctggcgcgcagatccccgctcgaatctatgcaccccaaagtcccgggcctcacccgggtgtcgtcttctttcacggtggcggttgggtgataggaagcatcaacacacacgatggggcctgtagaaggctcgctgaactgctggggtgtttagtcgtgtcggtccagtatcggaaggcacccgaattccagttcccgatcccgctggaagacgcttgggaagcaacaaagtgggtcttcagcaacgcggcacgcctcgacatagacccagctcgaatctcggtggtaggtgagagtgccggaggaaacctggcagccgtggttgcccggcgggcacgggaccatggcctctccctcaactcacaggtgctggtctacccggtaaccgactcagtcaccgacaacggctcctatgagaagaacgcgaccggattcaacctgaccaaggagcaaatggagtggttcatcggccactatgcccgtggccccgaagacctggttgaccccgacttctcgccgctgcgggcctcggacctaagaggcatggcaccggcatacattctcacggtcgaggccgacccgctacacgacgaaggagttgcctatgcggccgccttgtcttcggcaggagtcgacgtgacccacgaagacctcaccgatgtggtccacggcttcttcataatgaacgcaatcacacctgccacggacgagactatccgtcgcgtcgccgactacctgaaggcgatgtggtctcgacaaccctcatcggcggcgacgctgatcaattcgagcagcgacgacacgtcgagttcgccgaccgggtga

SEQ ID NO: 444 - protein, 337 aa, Unknown
  Obtained from environmental sample
MTSPDRSALRPEITEFLEELDAAGGSFAELAPDEVRPVVEELCRQLWGERVAVLTVADIEVPGSGAQIPARIYAPQSPGPHPGVVFFHGGGWVIGSINTHDGACRRLAELLGCLVVSVQYRKAPEFQFPIPLEDAWEATKWVFSNAARLDIDPARISVVGESAGGNLAAVVARRARDHGLSLNSQVLVYPVTDSVTDNGSYEKNATGFNLTKEQMEWFIGHYARGPEDLVDPDFSPLRASDLRGMAPAYILTVEADPLHDEGVAYAAALSSAGVDVTHEDLTDVVHGFFIMNAITPATDETIRRVADYLKAMWSRQPSSAATLINSSSDDTSSSPTG

SEQ ID NO: 445 - DNA, 429 bp, Unknown
  Obtained from environmental sample
atgaacacacccgcagtttcgttaggatacgtgattctttttgtccgcgacgtctcggcgagcctgacattctacgagcaggcgttcggactctcccggcgattcttcaacgacgacaacggcaaggcctatggcgagctggactccggcgccgcctgtctggcgtttgccaatttcgaaatggccaaggcgcaactgcagcaggaagtcgtatttgcctccccggacaaaccgccgctcggtgtggaggtcgcgctcgttaccgccgatgtgcccgagctttatgcccgcgccttgaaatccggagcgccttccatgcgcccaccggcaaccatgccgtggggacaaaccatcgcctacgtccgggacatcgacggtcacctgatcgagctgtgcacgcccgtagctcccccgccgccagccccgtaa

SEQ ID NO: 446 - protein, 142 aa, Unknown
  Obtained from environmental sample
  DOMAIN (7)...(131): Glyoxalase/Bleomycin resistance protein/Dioxygenase superfamily
MNTPAVSLGYVILFVRDVSASLTFYEQAFGLSRRFFNDDNGKAYGELDSGAACLAFANFEMAKAQLQQEVVFASPDKPPLGVEVALVTADVPELYARALKSGAPSMRPPATMPWGQTIAYVRDIDGHLIELCTPVAPPPPAP

SEQ ID NO: 447 - DNA, 876 bp, Unknown
  Obtained from environmental sample
atgtcttgtgatttttatcaacaaatacgccaacagttggatgatgttaaaaccgaagggctctataaatctgaacgcgtgatcacctcacagcaacaagcggcggtgtctatctcaaccggtcaagaagtgcttaacttttgcgccaataattatcttggtttagctaatcatcctgctttgatcgaagcgggccagcaaggtatggcaacccatggtttcgggatggcttcggtacgttttatctgtggtacgcaagatatccataagcagcttgaagagaagctgtctgctttccttggcaaagaagacaccattctttatacctcgtgctttgatgcgaataccgggttatttgaaactttgcttgataaagaagatgccatcatctctgatgcgctcaatcacgcttcgatcattgatggcgttcgtttatgtaaagcgatgcgttttcgttatagcaataacaacatgcaagagttggagcagcagctgattgctgctgatcaagcgggcgcacgccataagctgattgtcacagatggtgttttctctatggacggcgtagtggcgaacttgccagcgatttgtgatttagcagacaaataccatgctttggtgatggtagatgattcccatgcggtgggctttatgggcgcaaatggccgtggtacgcatgaatatcataacgttatcgacagaattgatattattaccggaacgctaggcaaagccatgggcggcgcttctggtggttatacctcaggtaaaaaagaagtgattgattggttacgtcagcgctcacgtccttatctcttctcaaactcggtcgcaccagcaattgtacgtgtgtattttcgtaattatgggtcttaa

SEQ ID NO: 448 - protein, 291 aa, Unknown
  Obtained from environmental sample
  DOMAIN (74)...(291): Aminotransferase class I and II
MSCDFYQQIRQQLDDVKTEGLYKSERVITSQQQAAVSISTGQEVLNFCANNYLGLANHPALIEAGQQGMATHGFGMASVRFICGTQDIHKQLEEKLSAFLGKEDTILYTSCFDANTGLFETLLDKEDAIISDALNHASIIDGVRLCKAMRFRYSNNNMQELEQQLIAADQAGARHKLIVTDGVFSMDGVVANLPAICDLADKYHALVMVDDSHAVGFMGANGRGTHEYHNVIDRIDIITGTLGKAMGGASGGYTSGKKEVIDWLRQRSRPYLFSNSVAPAIVRVYFRNYGS

SEQ ID NO: 449 - DNA, 999 bp, Unknown
  Obtained from environmental sample
atgaaattactgcgtgtctttgtgtgcgtttttgctttactcagcgcacacagcaaagccgatacacttaaagtaatggcttataatattatgcaactaaacgtacaagattgggatcaagcaaatcgtgcacagcgcttgccaaacgtcatatctcaattaagtgacagtcctgatgtcattcttatcagcgaagcgtttagcagccaatcagaatctgcgttagcgcaacttgctcaactttacccttatcaaactcccaatgttggcgaagactgtagtggcgctggctggcaaagcttaacgggtaactgctcgaatagcccctttgtgatccgcggtggagtggtgattttatctaagtaccccatcattacgcaaaaagcccatgtgtttaataacagcctgactgatagttgggattatttagcaaacaaaggtttcgcttatgttgaaatagaaaaacatggcaaacgttaccaccttattggcacgcatttacaagcaacgcatgatggcgacacagaagctgagcatattgtgagaatgggtcaattacaagagatacaagatttcattcaaagcgagcaaattcacacttctgagccggtcattatcggcggtgatatgaacgtagagtggagcaagcaatctgaaattacagatatgctcgaagtggttcgcagccgtctaattttcaacacacctgaagttggctctttctctgcaaaacacaactggtttaccaaagctaacgcctactatttcgactacagcttagagtataacgacacgctcgattatgtactttggcatgcagaccataagcaacccaccaataccccagaaatgttagtacgttacccaaaagcagagcgtgacttttactggcgttacttacgcggaaattggaacttaccttctggccgttattatcatgatggatactataacgaactgtctgatcactacccagtgcaagttaactttgaattttaa

SEQ ID NO: 450 - protein, 332 aa, Unknown
  Obtained from environmental sample
  SIGNAL (1)...(20)
  DOMAIN (23)...(330): Endonuclease/Exonuclease/phosphatase family
MKLLRVFVCVFALLSAHSKADTLKVMAYNIMQLNVQDWDQANRAQRLPNVISQLSDSPDVILISEAFSSQSESALAQLAQLYPYQTPNVGEDCSGAGWQSLTGNCSNSPFVIRGGVVILSKYPIITQKAHVFNNSLTDSWDYLANKGFAYVEIEKHGKRYHLIGTHLQATHDGDTEAEHIVRMGQLQEIQDFIQSEQIHTSEPVIIGGDMNVEWSKQSEITDMLEVVRSRLIFNTPEVGSFSAKHNWFTKANAYYFDYSLEYNDTLDYVLWHADHKQPTNTPEMLVRYPKAERDFYWRYLRGNWNLPSGRYYHDGYYNELSDHYPVQVNFEF

SEQ ID NO: 451 - DNA, 2772 bp, Unknown
  Obtained from environmental sample
atgcagtttagaaacttaagaatcaaaatcgttactgccattatcagcctgtttattttattggtttgcgtgtgttttacattaccagggcagaaattactggtttgggtagccaataaaacggtttcaggtctgcaaattgagagtatcgacaaacgaatattatctggtgctaaccttacgttacggtatgaaaatgacgatatcgcgatccgcctgcgaaacactcaggtgaacgtagaatggctaacgtgtgccagtatttgtatctccatggatgcgaacacgattgccatagtacaaaagcgcgaaggttcccgtgaagccaacgacgaagcgtccggcccaatagtgctgccgttaccagtggcgataaaacaggcaagaatccagcggctatcttttgaaacgcctaccattacagtgaatttgaaagcacttaatatgcaggttgctgggtctgattctcactttcaagtgccacaattatcgctagatacactgcagctgacgaccaaggctacgacgccgccggcatcggccaagtcgtcggtgtcacttgatgagttagcgcctttgcagctgcccaatattagtttgccactgacagctgaggtgggtgatctaaccattgataccttgtcgttggatgagcaaacgctcaacaatattaaacttgctcatgtggtgctagacaaaaacattacagttgaaaacgctcagcttaattatcaatcctactttttatccacggcagctgatgttgcactcgaaagttggactgttgatttgcgagccaccttaagtgcgccagtgggcttggccaattttaacttaactgggcagccaagcgagcttttgttgcgagtgaacacacaaggcatggcgtttgcaacacttcaggccgaggttgacttaacacgtcagaactggccatttgaggtgcaagggcaaatagataaaatggtgtcaccgtcacaacctgtaaggttaaacaatgcgaacttaacgctgcaaggcgatgcttcgaactacagtttgtctagtgcattgtctttatactcccgccagtttggtgacataacctcagcactcagcggacaaggagggcttcaagcgtttaccttggacaaagcggagctggcactggagcaggcaaaagctcagctcaatgggcaagttaattggtctaaaggggtaaaagggcaactcgctggtgatttttcaaagcttccaattgataggctgctgggcatattacaatacgacgctgggttaacagcaagcgatatgttgggcggacagtttgcgctgggctttgctagtgaacaacagcagtggcagcttgatatagatagttttacgcttgcaggaaaagtggcaggaacgccattgaatgcagacgtgaaagtgaaggtggatgaacgtctactcggtgagctgagccatgctcgcgtgaattacggaaagaacactctatcggtaagcggagcgctcggtcagaccttagatttagatgttgattttcagcttgatcaaaccgctaatgcattaattccagcagatgttaaaggccacggtgaagtctttattcagggcaaccatctgcaacctgtcatccaaacgaatgtacaaattgagtcagtgcgataccaagatatgctactgcaagggttatccactcatggcaaagtcgatattgctaattcagtgacgggacaagttggggtggcactggacaaggtggtgttcaattcagaaaccgttgaagatattcgcctcagcgctaaaggagatcaacaaaaccatacggtgacccttgatgttcgtgataagcgagcaattgcgagtattactgtcaatggcaaagttcagcaggctaaatggcatggcgaattaaccgcaggtgagctgacctcacaaggccgaacgctagcactgagagagcctgcagcaataatcctagggaaacaaactcaacaacttgcgcagcagtgttggcaaatggatagcactaatttgtgtttttcagcaaaacaagagggtttacagggacaagcagagttcagcttagacaagttagcgctcgaacagctacaaagctggttacctcaaacgttaaaagtccaaggtgaaacgaaggcaaatgcaaccttagcctggaacaaaggaaaagtgactcaagctaatggtcaactggaggtcattgaggctggagttacaactcatggccaaacgtttactatttctgagtttaaggccttactcaacaccgataacaaacagttgcacgctgattggcatatgaactcggataccttagggcgctttagcggcgatacccaaataccgttgaacaagcaagtccctgagctgttgggcaatattcaaattgagtcgattgaactggctaagttatcggcacttcttaatcgggtgacagagcaaagttttgatctacaaggaaacgtgcagggagacatcaaactttctgggagcttggctgcgcctgaggttaacggtaaagtaaccgctcagcgtttatttttggcgtcagattcattacctgttgaagtggactcaggccatatcaatgtgaattttaataccacatcggctcaacttgaagcgcagctgaacgccgctcgaggcggaaatgtggcgcttacaggggaagcgaattgggcgtcaggtgtagcggctgaggttaaaataaaaggggagaatatctatgtacaacccgactcgcaaattgagttaaccgcaagccca

SEQ ID NO: 452 - protein, 924 aa, Unknown
  Obtained from environmental sample
MQFRNLRIKIVTAIISLFILLVCVCFTLPGQKLLVWVANKTVSGLQIESIDKRILSGANLTLRYENDDIAIRLRNTQVNVEWLTCASICISMDANTIAIVQKREGSREANDEASGPIVLPLPVAIKQARIQRLSFETPTITVNLKALNMQVAGSDSHFQVPQLSLDTLQLTTKATTPPASAKSSVSLDELAPLQLPNISLPLTAEVGDLTIDTLSLDEQTLNNIKLAHVVLDKNITVENAQLNYQSYFLSTAADVALESWTVDLRATLSAPVGLANFNLTGQPSELLLRVNTQGMAFATLQAEVDLTRQNWPFEVQGQIDKMVSPSQPVRLNNANLTLQGDASNYSLSSALSLYSRQFGDITSALSGQGGLQAFTLDKAELALEQAKAQLNGQVNWSKGVKGQLAGDFSKLPIDRLLGILQYDAGLTASDMLGGQFALGFASEQQQWQLDIDSFTLAGKVAGTPLNADVKVKVDERLLGELSHARVNYGKNTLSVSGALGQTLDLDVDFQLDQTANALIPADVKGHGEVFIQGNHLQPVIQTNVQIESVRYQDMLLQGLSTHGKVDIANSVTGQVGVALDKVVFNSETVEDIRLSAKGDQQNHTVTLDVRDKRAIASITVNGKVQQAKWHGELTAGELTSQGRTLALREPAAIILGKQTQQLAQQCWQMDSTNLCFSAKQEGLQGQAEFSLDKLALEQLQSWLPQTLKVQGETKANATLAWNKGKVTQANGQLEVIEAGVTTHGQTFTISEFKALLNTDNKQLHADWHMNSDTLGRFSGDTQIPLNKQVPELLGNIQIESIELAKLSALLNRVTEQSFDLQGNVQGDIKLSGSLAAPEVNGKVTAQRLFLASDSLPVEVDSGHINVNFNTTSAQLEAQLNAARGGNVALTGEANWASGVAAEVKIKGENIYVQPDSQIELTASP

SEQ ID NO: 453 - DNA, 1347 bp, Unknown
  Obtained from environmental sample
atgaaagatctggcacagcagcaagtaggaaaagtcctggcacaaaccgccctggcgctggcggccctggtgggagcaacggcggcgcaggcatccaacaacgacccggtggtgctggtgcatggcttcctgggcttcggcccggacgaattgcagggcagcggcttctcctactggggcggcttcaacgacgtcgccgcccacatgcgcgaaggtaaccatcaagtgtttgccgccggcgtcgggccggtcagttccaactgggaccgcgcggtcgagctgtattaccagatcaagggcggctgcgccgactatggcgcgctgcacacggcgcaatacgcggcgttcggcgcgatccagaaaccggccggcaaatgctgggccgccgatccgaacaacaatcccaacaactacccgctggcgctctacccggcctgggacgccagccatccgctgcacctggtctcgcacagccagggcggccaaaccatccgcaccctgatccagctgatggaaaacggttcgccgaacggcaatgaaggcgacggcgcactatatgcgggcggcaagatcggctggatcaaaagcgccaccaccatctccacgccgcacaacggcaccacgctgcgcgacgtgatcgtcgatttcgtgcccaaggtatcggagctggccggccagatcgtccaggtggcgggattgggcggcagcaccagccccatctacaagttccggctggagcagttcggcctggcgcaaggtccggccgaatcgctgcaggacttcatcaaccgcaccaagggcgcgccgttctggtcgctgaacaaccatgacgcggcgcaatgggacctgggcccggacggcgcgcgcgagctcaacggctgggtcaagacctcgccccacgtctactactattcgatcggcagcaacgccaccgaacagggcagctggtgctgcaacggcaccgaccgcgtgatcgcaccgttccagagttccagctatcagtatgcgcgcaccgacatgatcttcttcctcaagaacacggccggcgaatgggtggtgccatcgatcctgcagcgcggcatgggctcttacacgcagaccgatcctggccgcgtcatcgtcgacagcagctggttccccaacgacggcgtggtcaacacggccagcatgaaagcgccagccggccagccggtgcgcaactacgacggcaactccgtggtgggcagctggaactacctgggctactaccgcggctacgaccacttcgacgtgatcggctggctgcaaccgtccgatggcgtgtacccgatctacgatagcctgaccgggatactctacggcctgtaa

SEQ ID NO: 454 - protein, 448 aa, Unknown
  Obtained from environmental sample
  SIGNAL (1)...(31)
MKDLAQQQVGKVLAQTALALAALVGATAAQASNNDPVVLVHGFLGFGPDELQGSGFSYWGGFNDVAAHMREGNHQVFAAGVGPVSSNWDRAVELYYQIKGGCADYGALHTAQYAAFGAIQKPAGKCWAADPNNNPNNYPLALYPAWDASHPLHLVSHSQGGQTIRTLIQLMENGSPNGNEGDGALYAGGKIGWIKSATTISTPHNGTTLRDVIVDFVPKVSELAGQIVQVAGLGGSTSPIYKFRLEQFGLAQGPAESLQDFINRTKGAPFWSLNNHDAAQWDLGPDGARELNGWVKTSPHVYYYSIGSNATEQGSWCCNGTDRVIAPFQSSSYQYARTDMIFFLKNTAGEWVVPSILQRGMGSYTQTDPGRVIVDSSWFPNDGVVNTASMKAPAGQPVRNYDGNSVVGSWNYLGYYRGYDHFDVIGWLQPSDGVYPIYDSLTGILYGL

SEQ ID NO: 455 - DNA, 1239 bp, Bacteria
atgaggagatacgtaaaagtaatgctttctattttacttattattagtttattttggtcgcctcttgaattaaaagcagaggaacaaaatcaaaaagaaccgattgttcttattcatggtttaggtggttggggccgtgatgaattgtttggttttaagtattggggcggttttaaagatatcgagacaaatttgaaccgacaagggtatagaacatatacagcttcggttggaccattttcaagcaattgggatcgtgcagcagagttatattcgtatttaaaaggtggaacagttgattatggagaagcacatgcgaaagcgcatggacatgcccgttatggaaaaacatattcaggggtatatagccaatgggataatcaacataaagttcattttgtaggacatagcatgggtggtcagacggcaagggttttattgcaactattaaaggagggaagtttagaagaacgagagtattataaacaacatccagaggtaggaatatctccgttatttgaagggaataaagattgggtacggagtgtaacaagcattggtacgccacataacggttctacgtttgcggatgaagaaacgatgtcttcgtttattaaagaatttgtaataaagattgctagtttatcaggtaataatccggaaacatttggctatgactttaaattggaacaatggggattaaagcgaaaacaaggagagagcttcttgcaatatgcggatcgaatgcttaatagttctgtttggaaaagtaaagatattagtgcatacgatttaacgacagctggatctaaagagcttaatcgatgggtaaaaacatatgatgatgtatattatttttcttatacaggagatgcgacgtatcgttcattactgacgggatattctgtacctttgttgacgatgaatccactgatgtacttgtctggcttacatattggaaagtttacacgaggatatacagagccaagtattaatgaaaaatggtggccaaatgatggacttgttagtgttgtttcgtcacaatatccgataggacatcgaaatcagctgtatgcaggaaatgctcaaaaaggtgtctggaattataccgtgacaaaatataattgggatcatatcgattttattggaatcgatcttgcggatactttggggattagtgatatatattcgttttataatgaagtggctgggaatatttatcgtttacctttgaattag

SEQ ID NO: 456 - protein, 412 aa, Bacteria
  SIGNAL (1)...(25)
MRRYVKVMLSILLIISLFWSPLELKAEEQNQKEPIVLIHGLGGWGRDELFGFKYWGGFKDIETNLNRQGYRTYTASVGPFSSNWDRAAELYSYLKGGTVDYGEAHAKAHGHARYGKTYSGVYSQWDNQHKVHFVGHSMGGQTARVLLQLLKEGSLEEREYYKQHPEVGISPLFEGNKDWVRSVTSIGTPHNGSTFADEETMSSFIKEFVIKIASLSGNNPETFGYDFKLEQWGLKRKQGESFLQYADRMLNSSVWKSKDISAYDLTTAGSKELNRWVKTYDDVYYFSYTGDATYRSLLTGYSVPLLTMNPLMYLSGLHIGKFTRGYTEPSINEKWWPNDGLVSVVSSQYPIGHRNQLYAGNAQKGVWNYTVTKYNWDHIDFIGIDLADTLGISDIYSFYNEVAGNIYRLPLN

SEQ ID NO: 457 - DNA, 1194 bp, Unknown
  Obtained from environmental sample
atgaacacacgaagttttcgcaagtttgtgagcgctgtcggcgtcattgcgatcctgttctcggtgcaacaggtacaagcctatgacgagatcgtggagaagcaggtctttgagcttgcctcctacacgaccaccggcggggagacgatcaaggacgtccgtatcggctgggaggcctacgggacgttgaacgaggccaaggacaacgtcatcctgattacccacttctattccggcaacagccatgccgccggccgctacaccgccgagggtcctgccggctattggaacgccatcatcggttcaggaaagccgatcgataccgacaaatactacgtcgtgtcgtccgacaccttggtgaacctcggcgccaacgatcccaacgtcatcaccaccggtccggcttccatcaatcccgacaccggcaagccttacggcatgagctttcccgtggtgacgattcgcgacttcgtggaggttcagaaggctctgctcgacagccttggcatcgacaaactgcatgccgtcgttggggcctcaatgggcgccctgcaggcctatgaatgggcggcggcctatcccgagcgggtcgagcgcctcattccggtgatcggcagcggctgggccgacggcgacctgatcgcctggctcaacatctggtcggcgccgatcaagctcgaccccaactggaatggcggcgattactatgacggcgagccgccgctgcaggggcttgccgagtcgctcaagatcgtgacgttgcaggccaaccactggaaatggtccaacagcgtgttcggccgcgcctgggccaaggacggtgccgatccggcggcaagcttcgacaatctgttcaggatcgaggcggtgcttgacggggccggccaggcccgcgccaagaccagcgatgccaatcatttcctctacctcgccaaggccaatcagctgttctatgccggccacggcgaaaccctttatgaaggcctgcgggcgatcacggcgccgacgctgatcatccatagcgatgacgacctgctgttcccgcccgccgcgatccgcgaaaccgcagccatgatcagatcgggcggcgcgccggttgacgtggtcgggattcaggccggccgcggtcatctcgatggagtcctggcgatcagccaggccggcgcgcagatcgaggcattcctcgcgaggtga

SEQ ID NO: 458 - protein, 397 aa, Unknown
  Obtained from environmental sample
  SIGNAL (1)...(27)
  DOMAIN (68)...(393): alpha/beta hydrolase fold
MNTRSFRKFVSAVGVIAILFSVQQVQAYDEIVEKQVFELASYTTTGGETIKDVRIGWEAYGTLNEAKDNVILITHFYSGNSHAAGRYTAEGPAGYWNAIIGSGKPIDTDKYYVVSSDTLVNLGANDPNVITTGPASINPDTGKPYGMSFPVVTIRDFVEVQKALLDSLGIDKLHAVVGASMGALQAYEWAAAYPERVERLIPVIGSGWADGDLIAWLNIWSAPIKLDPNWNGGDYYDGEPPLQGLAESLKIVTLQANHWKWSNSVFGRAWAKDGADPAASFDNLFRIEAVLDGAGQARAKTSDANHFLYLAKANQLFYAGHGETLYEGLRAITAPTLIIHSDDDLLFPPAAIRETAAMIRSGGAPVDVVGIQAGRGHLDGVLAISQAGAQIEAFLAR

SEQ ID NO: 459 - DNA, 834 bp, Unknown
  Obtained from environmental sample
atgacctttcccatcatcttggcgcacggcgtctgccggtttgacgtggtgatcaacgacttccttcatcttgacaacaacgatgaccccacgctggaccggctgcactattttcgcggcattcgcaccatgctgaaggccaacgggttccacgtctaccactccaaagtcagctgggcggccgacgtgacaacccgggcggaggatttgcgacgcaacatcgaagcggtcttgaacaaggaggaggccgacaaggtcaacatcatcgcccacagcatggggggattggactcccgacacatgctgttcaatggaagagactccaaccggatccatgaacgggttgcgtcgctgaccacgatttcgaccccacacgagggatcccccttcgccgactggatgaccgaccatctgcctcgggtcatcccgaccgcaagacagcttggactggatctgaaagcgctcagcgacctgcgcacagaccaatgcaaggcgttcaacgaccatccggacgtgatcgtcttcgagcaggaatgcgagaaaagcatccagtttcaaacttatgccggaaggcagcggttctggggcgttttcgacgctttgaaactgccgtactacgtcatcgaaaagcgcgaaggcgaaaacgacggcttggtctcggtgcagtccgcccgctggagagatcgctatttcaagggcacgatcgacgaaacggaccatttgaatgagctgggctggtgggagccggcgcagctctttgccggcgagggagagagcgagctgctggagcgcatccacaagctctatctgaacatagcgcaaggcctgccgtag

SEQ ID NO: 460 - protein, 277 aa, Unknown
  Obtained from environmental sample
MTFPIILAHGVCRFDVVINDFLHLDNNDDPTLDRLHYFRGIRTMLKANGFHVYHSKVSWAADVTTRAEDLRRNIEAVLNKEEADKVNIIAHSMGGLDSRHMLFNGRDSNRIHERVASLTTISTPHEGSPFADWMTDHLPRVIPTARQLGLDLKALSDLRTDQCKAFNDHPDVIVFEQECEKSIQFQTYAGRQRFWGVFDALKLPYYVIEKREGENDGLVSVQSARWRDRYFKGTIDETDHLNELGWWEPAQLFAGEGESELLERIHKLYLNIAQGLP

SEQ ID NO: 461 - DNA, 2205 bp, Unknown
  Obtained from environmental sample
atgagcgagaagaaggagattcgcgttgcgttgatcatggggggtggcgtcagcctcggcagtttttcgggtggtgcgcttctcaagaccatcgagctgctgcagcacactgcccgcggtccggcgaagatcgatgtcgtgaccggtgcctcggcgggaagcatgacgctgggcgtagtcatctaccacctcatgcggggatcgtcgaccgatgagattctccgcgatctgaggcggtcgtgggtggaaatgatctcgttcgacggcctctgtccgccgaacctgtcccgtcacgacaagccgagcctgttttccgatgagatcgtccggaagatcgcggccaccgtcatcgatatggggcgcaagctcgaggcggctcctcatccgcttttcgccgacgaactcgtagcctcgttcgcactgacgaacctgaacggcatccccgcccgtacggagggccagctcatccggcaggcaaagggaggcggagggtccgagaagggctcgaaatccgttttcgccgacgccgtgcagactacctttcaccacgacgtgatgcgattcgtggtgcggcgcgatcacaacgggcaaggcagcctgttcgacagccgttaccgggcacgcatactccctccatggaatgttgggaagggcggcgatgcatgggaagcctttcgcacggcggctgttgcctcgggggcgtttccggccgcatttcctcccgtcgagatcagccgcaaccgcgacgaattcaacatctggcccgatcgcatcgaggaccagaaggcatttacgttcgattacgtggacggcggggtacttcgcaacgaacccctccgggaggcgattcacctggccgcgctgcgcgatgagggagcgacggacatcgagcgtgtgttcatcctcatcgacccgaacatcagcggcaccggcgaggtcttcccgctctcctataaccagcagatgcggatcaagccgaactacgattccaacggcgacgtccgacagtacgatctcgatgtgccggactacaccggcaatctgatcggggcgatcggtcggctgggttcggtgatcgtcgggcaggcgacgttccgcgactggctcaaggctgccaaagtgaacagccagatcgagtggcgacgggaattgctgcccattctccgcgacctgaacccgaaccccggggaggaggcgcgcaggggcgtgaacgggatgatcgacaagatctaccggcaaaagtatcagcgcgccctcgagtcaaagagcgttccggtcgaggaggtggaacggcgcgttgccgaagacatcgaacgggacctggcgcggcgccgttcggaggccggcgacaacgacttcattgcccggctcctcctgctcgtcgacctgatcggcaacctgcgtgagaagcagaagctgaacatggtggcgatcacccccgcttccgcgccgcacaacgacgggcgccccttgccgctggccggcaattttatgttcagcttcggggggttcttcagggaggagtacaggcaatacgacttctcggtcggcgaattcgcagcatggaacgtcctgagcacgccggcctccgagacgccctttcttgccgagaccgccccgaaaccgcccgcccgacctccccagccgccggcaatcaatcctacctaccgctcactcggcccgcccatccagcagcggttcgaggagttcgttcgtgggcacgttcgcgcctttatcgcttcggtcgctccgctgggaacgagagggatcgtcacgggcaagattggcggaaagcttcgaacgatgctgatggcctcgcgcaacgggaaatcagagtacttccggcttcgcctctccggcgttgacgggctctacctccgaggctccaagggccgcaacctgagggcggttaacggatcgatcgacacggtcgtcggcgtctatatcgacgaggaagatcagcaccgcgatgagtttttcggtccccatgtcttcggcgcgaacggctcaggctttacgatggaactatgggagtcccgcggttttttcgggcgtgatcgtcgcgtcgctgtgatcgagttggagaacaaccccggcgggttcgcaatcgccgccggatgcaggcggcggcccggcgtggtgctggatatggccaggcgtaacgggcagccactgcggacggtggatgtgatggaatttgcgtga

SEQ ID NO: 462 - protein, 734 aa, Unknown
  Obtained from environmental sample
  DOMAIN (11)...(283): Patatin-like phospholipase
MSEKKEIRVALIMGGGVSLGSFSGGALLKTIELLQHTARGPAKIDVVTGASAGSMTLGVVIYHLMRGSSTDEILRDLRRSWVEMISFDGLCPPNLSRHDKPSLFSDEIVRKIAATVIDMGRKLEAAPHPLFADELVASFALTNLNGIPARTEGQLIRQAKGGGGSEKGSKSVFADAVQTTFHHDVMRFVVRRDHNGQGSLFDSRYRARILPPWNVGKGGDAWEAFRTAAVASGAFPAAFPPVEISRNRDEFNIWPDRIEDQKAFTFDYVDGGVLRNEPLREAIHLAALRDEGATDIERVFILIDPNISGTGEVFPLSYNQQMRIKPNYDSNGDVRQYDLDVPDYTGNLIGAIGRLGSVIVGQATFRDWLKAAKVNSQIEWRRELLPILRDLNPNPGEEARRGVNGMIDKIYRQKYQRALESKSVPVEEVERRVAEDIERDLARRRSEAGDNDFIARLLLLVDLIGNLREKQKLNMVAITPASAPHNDGRPLPLAGNFMFSFGGFFREEYRQYDFSVGEFAAWNVLSTPASETPFLAETAPKPPARPPQPPAINPTYRSLGPPIQQRFEEFVRGHVRAFIASVAPLGTRGIVTGKIGGKLRTMLMASRNGKSEYFRLRLSGVDGLYLRGSKGRNLRAVNGSIDTVVGVYIDEEDQHRDEFFGPHVFGANGSGFTMELWESRGFFGRDRRVAVIELENNPGGFAIAAGCRRRPGVVLDMARRNGQPLRTVDVMEFA

SEQ ID NO: 463 - DNA, 1854 bp, Unknown
  Obtained from environmental sample
atgggtgtgtttgattacaagagcttcactgcaagtgattccaaggcgctgtttgccgatgccatggcgatcactctgtattcctaccacaacctcgacaacggctttgccgtgggttaccagcacaatggcttcggcctgggcctgccggcgaccctggtcacggcgctgatcggcagtggcgattcccagggggtgatcccggggattccctggaaccccgattccgaaaaggccgcgctggacgccttgcacaaggctggctggtcgaccatcagtgcccagcagttgggctacgacggcaaggtcgacgcccgcggtaccttcttcggcgagaaggccggttatgacacggcgcagctggaaatcctcggcaagtacgatgcccagggccacctggagtccatcggcattgcctttcgtggcaccagcgggccgcgggaatcagtgatcggcgacaccatcggtgacgtgctcaacgacctgctggcggccctggggcccaaggactatgcgaagaactacgccggcgaggcattcggcaagctgctggggaacgtcgccgcgttcgcccaggccaatggcctgtccggcaccgacatcctggtcagcggccatagcctgggcgggttgggggtcaacagcctggccgacctgagcagtgaacgctggtcggggttctacaaggactccaactacatcgcctatgcctcgccaacccagagcgccagcgacaaggtgctgaacatcggctacgagaacgacccggtgttccgcgccctggacggctccagcttcaacttgtcgtcgctcggggtgcatgacgcccaccaggactcggcgaccaacaacatcgtcaacttcaacgatcattacgcctcgagcctgtggaacgccttgccgttctcgatcctcaacatccccacctggatctcgcacctgcccactggctacggcgacggcctgacccgggtgctggagtcgaagttctacgatttcaccagcaaggactcgaccatcgtggtggccaacctgtcggacccggcgcgggccagtacctgggtccaggacctcaaccgcaacgccgagacccacaagggcagcaccttcatcatcggcagtgacggcaacgacctgatccagggcggcaacggcaacgactacctggaaggccgggcgggcaacgataccttccgcgacagcggcggctacaacatcatccttggcggccagggccacaacaccctggacctgcagcactcggtgcaggactacagtttcgccagcgacggcgctggcaccctgtacgtgcgtgacgccaatggcgggatcagcatgacccgcgacatcggcgcgatccagagcaaggaaccggggttcctctggggcctgttcaaggacgatgtgacccaccaggtcagcgagcaggggctcaaggtcggcaaccaactgaccgcgtacgcgtctgcgctcaagggcgatgccgctgacaacgtgctcaaggcccatgacggcggcgactggctgttcggcctcgacggcaacgatcacctgatcggcggccagggcaatgacgtgttcgtcggcggcgccggcaatgacctgatggagtcgggcggtggccacaacaccttcctgttcaccgggcatttcggccaggaccgcatcctcggctaccagagtggcgacaagctggtgttcatgggcgtcagtggcgtgctgccggaccaggactaccgggctcacgccagcagcagcggccacgacaccgtgctgaccttcggccaggactcggtgaccctggtgggggtcagcctggagcacctcaacggttccggcatcgttctcgcctga

SEQ ID NO: 464 - protein, 617 aa, Unknown
  Obtained from environmental sample
  DOMAIN (133)...(265): Lipase (class 3)
  DOMAIN (381)...(398): Hemolysin-type calcium-binding repeat (2 copies)
  DOMAIN (510)...(527): Hemolysin-type calcium-binding repeat (2 copies)
MGVFDYKSFTASDSKALFADAMAITLYSYHNLDNGFAVGYQHNGFGLGLPATLVTALIGSGDSQGVIPGIPWNPDSEKAALDALHKAGWSTISAQQLGYDGKVDARGTFFGEKAGYDTAQLEILGKYDAQGHLESIGIAFRGTSGPRESVIGDTIGDVLNDLLAALGPKDYAKNYAGEAFGKLLGNVAAFAQANGLSGTDILVSGHSLGGLGVNSLADLSSERWSGFYKDSNYIAYASPTQSASDKVLNIGYENDPVFRALDGSSFNLSSLGVHDAHQDSATNNIVNFNDHYASSLWNALPFSILNIPTWISHLPTGYGDGLTRVLESKFYDFTSKDSTIVVANLSDPARASTWVQDLNRNAETHKGSTFIIGSDGNDLIQGGNGNDYLEGRAGNDTFRDSGGYNIILGGQGHNTLDLQHSVQDYSFASDGAGTLYVRDANGGISMTRDIGAIQSKEPGFLWGLFKDDVTHQVSEQGLKVGNQLTAYASALKGDAADNVLKAHDGGDWLFGLDGNDHLIGGQGNDVFVGGAGNDLMESGGGHNTFLFTGHFGQDRILGYQSGDKLVFMGVSGVLPDQDYRAHASSSGHDTVLTFGQDSVTLVGVSLEHLNGSGIVLA

SEQ ID NO: 465 - DNA, 1038 bp, Unknown
  Obtained from environmental sample
atgagcgagtcgcgcacgcatccgccgctggagctgtctcacaccgccatgagcgaggaggaggcgcttcgcttcctggacggccaccggatccgcctggggcaccgcacgatggaccccaaggcccagatcgtgggtgagttcgtcaaatcgatccgcgtgccggggtacttcccgccgctgccagagctgcgccagcaactccgcaccatggtgacgctgatggatgagccggcgccgacactgccgcgcgtcgaggacatccgcattccggggccggccggccacatcccggcgcgggtctacgcgccgggcgccgacgacgcgctgcggccgtgcgtggtgtacttccacggcggcggctgggtgcagggggatctcgagacccatcatgggctctgcgcgcgactcgccacgcacgggggcgtgctcgtcatcgccgtcgactaccggctggcgcccgagcacaagttcccggctgcggtcgaggactgcctggcggcctatcgctggctccgggctcatgggcgcgacgtcggcgccgaccccgaccgcgtggcggtggccggcgactcggccggcgggaatctctcggctgtcgtcgcgcagctcgccgcctccggcggggcgccggtgcccacgtgccaggtcctcatctaccccgccgtcgacttctccctcgagacggagtctcaccgcgacctggcggacgggcacgtgatcccgcgcgaccgtatcgtctggtacacggagcaatatctcaggagcgaagcggacaaggccgatctgcgggcctcgcccctccgcgcgccgagcctcgccggccagccgccggctctggtcgtcaccgccggcttcgatccactgcgcgacgagggccgggcgtacgccgatcggctgcgcgaggccggcgtggacgtcgtcgaccgtgagtacccgggccagatccacgcgttcgtgtcgctgaccaaggccatcccgcaggggatggcctgtaccctggagatcgcgaactatctgcggcagcgtctcgggtga

SEQ ID NO: 466 - protein, 345 aa, Unknown
  Obtained from environmental sample
MSESRTHPPLELSHTAMSEEEALRFLDGHRIRLGHRTMDPKAQIVGEFVKSIRVPGYFPPLPELRQQLRTMVTLMDEPAPTLPRVEDIRIPGPAGHIPARVYAPGADDALRPCVVYFHGGGWVQGDLETHHGLCARLATHGGVLVIAVDYRLAPEHKFPAAVEDCLAAYRWLRAHGRDVGADPDRVAVAGDSAGGNLSAVVAQLAASGGAPVPTCQVLIYPAVDFSLETESHRDLADGHVIPRDRIVWYTEQYLRSEADKADLRASPLRAPSLAGQPPALVVTAGFDPLRDEGRAYADRLREAGVDVVDREYPGQIHAFVSLTKAIPQGMACTLEIANYLRQRLG

SEQ ID NO: 467 - DNA, 267 bp, Unknown
  Obtained from environmental sample
atggccgcatcctgtccccacctggccgagatccagacccgcgccgccaagaccgacggctgcgaagaatgcttgaagaccggcgagacctgggtccatctgcgcgtctgcttggtatgcggcaaggttggttgctgcgacaactcgaagaacaagcacgccacccggcatttccacgaaaccagccacccggtcatgcgctcgaaagaaccgggcgagacctggggctggtgctacgtcgaccgcaagatgttcgatccgatctga

SEQ ID NO: 468 - protein, 88 aa, Unknown
  Obtained from environmental sample
MAASCPHLAEIQTRAAKTDGCEECLKTGETWVHLRVCLVCGKVGCCDNSKNKHATRHFHETSHPVMRSKEPGETWGWCYVDRKMFDPI

SEQ ID NO: 469 - DNA, 975 bp, Unknown
  Obtained from environmental sample
atgtgggtgcagcgtgccgtcgggctgctgcttatcctcagcgcgctggcgctggcgctgtcgcgtgcgcccgatgtgccggctgaaggcctggtggcgcgctgggcgccgccgccctcggacttcattgccgtccaggggcagaccgtgcacttgcgcgacgaaggcccgcgccacgacggcgccgccaacggcccgccgcccatcgtgctcatccacggcacctcggccagcctgcacacctgggagggctgggccaaggcgctgaggggccagcgccgcgtcatcagcttcgacctgccgggtttcggcctcaccggcccgttcattgccaacccggccggcggctacgaggccgacaactaccacggcgacacctacgcgcgcttcgtgctcgacctgctggacgcgctgcaggtcaggcgtgccgtcatcgccggcaactcgctgggcggtgaagtggcttggcgcaccgccgcgatggcgcccgagcgtgtcgccggcctcgtgctggtggacgccgcgggcccgcgcttcacgccccaggccgtgccgctggggtttctgctggcgcgcgtgccggtgctcaacaagctgggtgaatgggcgctgccacgcggcatggtggtcgaaggcctgcacagcgtctatggcgaccccacgcgcgtcaccgaggagctggtggaccgctacttcgagctcgcgctgcgcgaaggcaaccgccgcgccctgggtctgcgcatacggcagatggagatgggcgcggacgaggaacgcatcgccacgctgaagctgcccacgctcattctgtggggcggccgcgaccgcctgataccgcccgcggtgggcgaggagttcgaacgtcgcattgtgggcagccggcgcgtggtgttcgagcagctgggccacgtgccgcaggaagaagacccggtcctgagcgtggggccggtgaaggaattcctggcgctgcactga

SEQ ID NO: 470 - protein, 324 aa, Unknown
  Obtained from environmental sample
  DOMAIN (93)...(319): alpha/beta hydrolase fold
MWVQRAVGLLLILSALALALSRAPDVPAEGLVARWAPPPSDFIAVQGQTVHLRDEGPRHDGAANGPPPIVLIHGTSASLHTWEGWAKALRGQRRVISFDLPGFGLTGPFIANPAGGYEADNYHGDTYARFVLDLLDALQVRRAVIAGNSLGGEVAWRTAAMAPERVAGLVLVDAAGPRFTPQAVPLGFLLARVPVLNKLGEWALPRGMVVEGLHSVYGDPTRVTEELVDRYFELALREGNRRALGLRIRQMEMGADEERIATLKLPTLILWGGRDRLIPPAVGEEFERRIVGSRRVVFEQLGHVPQEEDPVLSVGPVKEFLALH

SEQ ID NO: 471 - DNA, 1185 bp, Unknown
  Obtained from environmental sample
atgacagcgacagggagaggaacaacagagcaggcgaaccgcatcgttcagcaggccgtcgatgctgcgatccgtgacggtggagagattggcctgcaagtagccgcctatgtgaatggcgaactcgtggtggacgtctggggcggcctggcggatgaaaccactggacggaaggtcaatggcgataccctctttcccgtcttctcggtcaccaaggccgtcacggcgacggccttgcatatccaggcagagcgtggcttggtcgagtatgatacgcccatcgctcgctactggccggagtttggcgcgcacggcaaggacaagggaacggtgcgcgatgcgctcacccaccggatcggcatcccccagatgcccgagggcgtgacgcccgagcaaatgtgcgattgggagtggatggtgcagcggctggcggacaccaagcccctctttgccccgggcaccaagagcgcatacctggcgtacacgtttggctggatcattggcgagatcgtgcggcgcacggatcctaacaggcggcccttcggcagatttgtccaggaagagatctgtgccccgttgggcattgataacctctggcttggcatcccggacgcggtggagccgcgggtggccaagctcaccaatatccctcgacctgcccccggagcgccggggctccctgccgagtcgctcctcccgctggcaatcccccctcaggtggggacggtccaaggggtgttcggccggcctgatgtgcgccgggcctgtattcccggcgccggcggcatcatgaacgcgcgcagcgcggcgaggttttttgccctgctggccaatggcggggagctgaatggagcgcgcctcctctcgcaggagcgcgtccgttccttcagcacgccgcgggcgaggcgggaggagttcgatccagtggtctggagtgtcctgaatctgggcatggccgggttttggctcggtggcgagtcgcccccttcggccccggtcgtcgggcgcaacccgcacatcatttgccatcctggggcaggcgggtcgatcggctgggccgacccagacgcctgcctggccgtggccatctgtcataaccggatgtttcacgcacccacgcccaaggggaacccattcgcgccgatcggggacgctgtgcgggcggcgctgggggtagcaggctaa

SEQ ID NO: 472 - protein, 394 aa, Unknown
  Obtained from environmental sample
  DOMAIN (16)...(385): Beta-lactamase
MTATGRGTTEQANRIVQQAVDAAIRDGGEIGLQVAAYVNGELVVDVWGGLADETTGRKVNGDTLFPVFSVTKAVTATALHIQAERGLVEYDTPIARYWPEFGAHGKDKGTVRDALTHRIGIPQMPEGVTPEQMCDWEWMVQRLADTKPLFAPGTKSAYLAYTFGWIIGEIVRRTDPNRRPFGRFVQEEICAPLGIDNLWLGIPDAVEPRVAKLTNIPRPAPGAPGLPAESLLPLAIPPQVGTVQGVFGRPDVRRACIPGAGGIMNARSAARFFALLANGGELNGARLLSQERVRSFSTPRARREEFDPVVWSVLNLGMAGFWLGGESPPSAPVVGRNPHIICHPGAGGSIGWADPDACLAVAICHNRMFHAPTPKGNPFAPIGDAVRAALGVAG

SEQ ID NO: 473 - DNA, 453 bp, Unknown
  Obtained from environmental sample
gtgagcagcgacctcgacagaccgtatcggggtggattcgtaggccgcgagcatcgcttcgcgctgaccgtctatttcgaggacaccgacaccgccggcattgtctattacgccaattacctgaaattcatggagcgggcgcgctccgacatgcttcgcgccgtcggcatcgaccagaaagcggagctggcaacctcgggctgcgcctatgcggtcgccgatgtcgccatcaaatatcgaaagcccgcctatctcggcgaggaccttgtggtggtcagcacggtggaggcggttcggtcggcgtcggtgacgattcatcagacagtcatgcgcggggccgaattaataaccgacagcatcgtcaccgcagccttcctggattcggagcaaagaccgaagcgccagcccaaggcttgggtggagcggttcaattcgattgccaaaggggaatga

SEQ ID NO: 474 - protein, 150 aa, Unknown
  Obtained from environmental sample
  DOMAIN (22)...(124): Thioesterase superfamily
MSSDLDRPYRGGFVGREHRFALTVYFEDTDTAGIVYYANYLKFMERARSDMLRAVGIDQKAELATSGCAYAVADVAIKYRKPAYLGEDLVVVSTVEAVRSASVTIHQTVMRGAELITDSIVTAAFLDSEQRPKRQPKAWVERFNSIAKGE

SEQ ID NO: 475 - DNA, 1158 bp, Unknown
  Obtained from environmental sample
atgaacagatggctcaaattcctgatcggcctggcactcgggctggttctggccgcactctacgtactgaatccacgtctgccttcaccagagggtgaacaaagcgccctgctgtaccaacccggcagcttcggtgtccagcaagagtccatcgccctgatcgactcctctcggcccacacgtgccaatggtgacttcgcgggcagcgacgtgcgtgaactgaacgggtatgtctggtatcccgatgcagaccctcgatcacatggcccgtttccgctgattgtgtacagccacggtttcatgtcctcggtggcggaaccggagtacctcgtggactttctggtgcccaagggttatgtggtggtggcggtgaactatccactcagccacggtggtgcaccgggtggcccgacggtggtggatgtcatcaatcaacccggcgatgtggcctttgtcatcgataccctgctggccagaaataccgatgcacaggattcactgttcgggcttgtggatcctacgcgcatcgccgctgtgggtctgtcactcggggggctgacaacccagcttgcggcgtttcaccgggatgaacgcgacccgcgtattgctgctgccgtttccatagccggaccgagctcaccactggaggcacggtttttcgagactgcggacgtgccgttcatgatgattgccggcagtggtgatgccattgtgccttatgaggccaacgccgagtctatcccatccagggcacccggcagtgtgctggtgacgctggacggcggttcacatgtgggatttgccggcattgccaccaccgccttccgatggttccgtcatccggacaggtgggtatgccccatgctgctcagtggactcgaccgggaggacaatgagggagaactgctgcttgaaccggatccggacattggaatttccaccaacatggtggcaccctgcaccatggaaacctgggaacgggccatgcgtccggcccggcagcagatgctcactcgcctggcactgtacgcctttctggagcagcatttcaatgccgacgcagcagtgcgtcagcaaatgagcagctacattgcacaaggtttgtcagcagaacatccggacgccgttgtcacacccggcgccttgccgtatcgttga

SEQ ID NO: 476 - protein, 385 aa, Unknown
  Obtained from environmental sample
  SIGNAL (1)...(18)
MNRWLKFLIGLALGLVLAALYVLNPRLPSPEGEQSALLYQPGSFGVQQESIALIDSSRPTRANGDFAGSDVRELNGYVWYPDADPRSHGPFPLIVYSHGFMSSVAEPEYLVDFLVPKGYVVVAVNYPLSHGGAPGGPTVVDVINQPGDVAFVIDTLLARNTDAQDSLFGLVDPTRIAAVGLSLGGLTTQLAAFHRDERDPRIAAAVSIAGPSSPLEARFFETADVPFMMIAGSGDAIVPYEANAESIPSRAPGSVLVTLDGGSHVGFAGIATTAFRWFRHPDRWVCPMLLSGLDREDNEGELLLEPDPDIGISTNMVAPCTMETWERAMRPARQQMLTRLALYAFLEQHFNADAAVRQQMSSYIAQGLSAEHPDAVVTPGALPYR

SEQ ID NO: 477 - DNA, 885 bp, Unknown
  Obtained from environmental sample
atgcaaggattcaagcatactcatcatctgtctctgctcgcggccacggtgctggccggctccagcctgctcggcgcgtgcgccagcagcggcaacagcgggttcgagctcgacaccgagggcgcgctcgcgggcaacttcccctccgtcagctcgttcgcggatcccggcccgttcgacacgacccagcaggcgctgggcgactgcaccgtgcaccgccccaacacgctcggagagaacggcctcgtgcacccggtcatcatctggggcaacggcacgttctcgtggccggcgatctacggcggcctgctctcgcacctcgcgagccacggcttcatcgtcgccgcggcgaacacgtcgaacgccggcgacggcagccagatgatcgcgtgcctcgacgccgtgctcgccgccagcgagacggccggcagcccgttctacaagcacgtcgacgccgcgcacgtcggcgcggccggccactcgcagggcggcgccggcacgatcatggccggccgcgacgcgcgcgtgcgggtgaccgcgccggtcgagccgtacatcggctggatccccggcggcggctcgttcgacgacgacgcgatctgggagcagcagggcccgatgttcctgctctccggctcgctcgacgtggtggcgctgcccctgctgcaccagcgccccgtgtacgacgacgtcaaccagcccgtgttctgggccacgcgctccggcgtgacgcacttcgagccggtcggcgacgccggcgagttccgggctccgctcacggcatggttccgggcctggctcatgggcgatacggcggctgcgaaggtgttctcgaacccgtgcacgctgtgctcgaagagggagtggacgatccacttccagtag

SEQ ID NO: 478 - protein, 294 aa, Unknown
  Obtained from environmental sample
MQGFKHTHHLSLLAATVLAGSSLLGACASSGNSGFELDTEGALAGNFPSVSSFADPGPFDTTQQALGDCTVHRPNTLGENGLVHPVIIWGNGTFSWPAIYGGLLSHLASHGFIVAAANTSNAGDGSQMIACLDAVLAASETAGSPFYKHVDAAHVGAAGHSQGGAGTIMAGRDARVRVTAPVEPYIGWIPGGGSFDDDAIWEQQGPMFLLSGSLDVVALPLLHQRPVYDDVNQPVFWATRSGVTHFEPVGDAGEFRAPLTAWFRAWLMGDTAAAKVFSNPCTLCSKREWTIHFQ

SEQ ID NO: 479 - DNA, 1272 bp, Unknown
  Obtained from environmental sample
atgaacaacacacgtgccctcaggcatgccgctgccgcattcacgttcgccctggccggcgcccccgcgctggccgccaacagctaccccgtgatcctcgtccacggcttcgccggcttcggccgctccgagctgctgggctacaagtactggggcggcctcaacgacctgcaggagcagttgaaggccaggtactcgaaccagctggtggccaccgcggtcgtcggcccgttcagctcgaactgggatcgcgccaccgaacttttctaccagatcaagggcggctgcgtcgactacggcgcgctgcatgcggcggcgaacgggcacctcgaacggccggagagcttcttccacaatggccgcacctgctaccccgggctgtatccggcctgggacgccagccatccggttcacctcatctcgcacagcatgggcggccagacctcgcgcatgctggtgcaactgctggccgccaacggcgcgcccgccaatccatcgctgtttccgtatgcggtcaacgcgagctgggtcaagagcgtgacgacgatcgccacccccaatgacggcaccacgctcgcctaccgcatcgtcgactgggtgccgttcgtgcagcagctcgtgaccggcatcgcgggcgcctccggcgcgaccggaggcaacgccatctacgacttcaagttcgatcaatggggcgtcgggccgcgcacggccggcgagagcttcggcgactacgtgaaccgcgtgaccagcctgccgctctggaactcgggcatcaaggacctgtcgccgtacgacctctcgcccgcgggcgcgatggccgagaacgactgggtcaaggaccagcccgacgtcacgtacttctcgtgggtcacgaactccagctacacgggcatcctcacgggctggtcgtatcccgacctcgataccaacgtcctgatcggcgcgttcgccggccccggcttcatgggcaacttctaccgcgactcgcgcccgatgccgccggtcgccgacagcagctggttccccagcgacgcagtggtgaactcgatcgcgcagaaggcgccgacctgggcgatgaacgcgtcgggcaccatctacaggcgatccgtcgtcgtccgcgacatcagcaacggcggcacgccgcaggccggcgcctggaactacaagggccagctgagcggcttcgaccacctcgacgccgtcggctggacgctgttctgggacagcctgggctggtacaaggcgcgcgtggacgagctgcgggcgctgtag

SEQ ID NO: 480 - protein, 423 aa, Unknown
  Obtained from environmental sample
  SIGNAL (1)...(25)
MNNTRALRHAAAAFTFALAGAPALAANSYPVILVHGFAGFGRSELLGYKYWGGLNDLQEQLKARYSNQLVATAVVGPFSSNWDRATELFYQIKGGCVDYGALHAAANGHLERPESFFHNGRTCYPGLYPAWDASHPVHLISHSMGGQTSRMLVQLLAANGAPANPSLFPYAVNASWVKSVTTIATPNDGTTLAYRIVDWVPFVQQLVTGIAGASGATGGNAIYDFKFDQWGVGPRTAGESFGDYVNRVTSLPLWNSGIKDLSPYDLSPAGAMAENDWVKDQPDVTYFSWVTNSSYTGILTGWSYPDLDTNVLIGAFAGPGFMGNFYRDSRPMPPVADSSWFPSDAVVNSIAQKAPTWAMNASGTIYRRSVVVRDISNGGTPQAGAWNYKGQLSGFDHLDAVGWTLFWDSLGWYKARVDELRAL

SEQ ID NO: 481 - DNA, 750 bp, Unknown
  Obtained from environmental sample
atgagagttgtacaacccaaaccttttacttttgaaaaaggtccgcgggccgttttattattgcatggttttacggggcattctgccgatgtacggatgcttggacgctttttagaagagagaaactatacatgccatgcaccgatttatcgtggacatggtgttgcaccagaggagttaataaagacaaaccccaatcagtggtgggaagacgttgaggaagcttttaaccacttaaaagaacgcggttatgaggaaattgcagtagcgggtctttcacttggtggggtttttagtttgaaacttgcttatacgaaacccgtaaaagcagttattcccatgagtacaccgatgtttttcgacaatgaagaacaattaacaaatgggtttcattactttacaagacaatataaaagattagaaggaaaatcaaaagaggaaatcgaggatgaaacaaaagcggtcatggaggattccggatcgatattcaatcaagtggctgattacattgctgatgtgaggtcccatgtggatttaatttatacgccggcgatggtcgtccaggcgggaaaagatcaaatgatcaataaggacagtgcaaattatatctacgaacacctggaatcagataaaaaagaaataaaatggtatgaggaatcaggacatgtcattacggtcgataaagaaaaggaacagctttttgaagatatctatcaatttttagagtctttagactggaaatcatcgtaa

SEQ ID NO: 482 - protein, 249 aa, Unknown
  Obtained from environmental sample
MRVVQPKPFTFEKGPRAVLLLHGFTGHSADVRMLGRFLEERNYTCHAPIYRGHGVAPEELIKTNPNQWWEDVEEAFNHLKERGYEEIAVAGLSLGGVFSLKLAYTKPVKAVIPMSTPMFFDNEEQLTNGFHYFTRQYKRLEGKSKEEIEDETKAVMEDSGSIFNQVADYIADVRSHVDLIYTPAMVVQAGKDQMINKDSANYIYEHLESDKKEIKWYEESGHVITVDKEKEQLFEDIYQFLESLDWKSS

SEQ ID NO: 483 - DNA, 1365 bp, Unknown
  Obtained from environmental sample
atgaaattgcaactcttaatacttttagtttttgtgatttctgttgttggagctactaaaatcagcgatcttggagaagtttatactgtgaaaactgcggacggaattacattgaaactcctgagatatcatccacccggtgggcaaccaaacgctggagctcagccagttttgctattttctggattgctttgcaacatgaacgaatttgtcgtattcacaccagatggacttgaaagcaagtacaaaccctactatcctaaggaacttgcagaatgggctaaagatgatccctacatagccaaagacccgatgctctactacagtctcgcacactacctgtggaaaaaaggttacgatgtctggctgctcaactatcgtggaactggtgtaggagagatgaaaagcggtgttggcaatgcaagagttagccttgacgtctgggccctctacgatgttcctgcagcgatcgattttgtaaataaaaagactggaaaaagcctaattattggcggccacagcacgggaggacttgtaacctatgtatatttgcaaggagcaaaattcgtcaaaactccatcatgcctgataaatttggcttggtgtgaaaaagtttcggcatcagattcgcttgcagaagaaagaaacagtaagatcgttggcgtcattgcaatcgatccagcgatgattcctcctttgcccaaaatacttgatacaaaagctggatggttgcttcttgacacaccgctttacatagacttgagggacacaattgagactttagcgaagaaaaaagggctgtgggaaagtttccttttgactgagaagtttttattcgaagctatatactcgctttacaatcgctacggagagatatctgagataataaaagctctggctttcatgaatccgaacaacatgaatcctgctttgtcagacttcatgacaagatacgtagccgatagtctttacacacctacattagcccagtatgcggattttggtttaagaaatactgcaagagagtattttgaaaacggtgggaagggatatctggtcgttccaccatatcctaggcctggcgatggttactactattataaaggagagaatatgaaaaaagttaaagttccatacataactatcctctctgagcttccaggtttggttgatgcaaatcaaattataaaagacttgatgcaggctaaaacaaagcatcaactcgacagatactatataatccctggcacgggacacttagacgtagccttgggcctgaatgtcccgacagaagtctttccgaaaattggagcttggcttgatgatctgcaagaattaataggatacccaactactccgcattaa

SEQ ID NO: 484 - protein, 454 aa, Unknown
  Obtained from environmental sample
  SIGNAL (1)...(17)
MKLQLLILLVFVISVVGATKISDLGEVYTVKTADGITLKLLRYHPPGGQPNAGAQPVLLFSGLLCNMNEFVVFTPDGLESKYKPYYPKELAEWAKDDPYIAKDPMLYYSLAHYLWKKGYDVWLLNYRGTGVGEMKSGVGNARVSLDVWALYDVPAAIDFVNKKTGKSLIIGGHSTGGLVTYVYLQGAKFVKTPSCLINLAWCEKVSASDSLAEERNSKIVGVIAIDPAMIPPLPKILDTKAGWLLLDTPLYIDLRDTIETLAKKKGLWESFLLTEKFLFEAIYSLYNRYGEISEIIKALAFMNPNNMNPALSDFMTRYVADSLYTPTLAQYADFGLRNTAREYFENGGKGYLVVPPYPRPGDGYYYYKGENMKKVKVPYITILSELPGLVDANQIIKDLMQAKTKHQLDRYYIIPGTGHLDVALGLNVPTEVFPKIGAWLDDLQELIGYPTTPH

SEQ ID NO: 485 - DNA, 2283 bp, Unknown
  Obtained from environmental sample
gtgttatgtgcgctgggcggagcagggcgcttgagctataccgtcgccgtgcgggcattgtgcgagttcacggccaaggcgggtgacctcgatttgcggtttaccccgtcgcccagtgcccaggaaggcatggttgggcatcgcatggtggcatcgcgccgcagcgcgcactaccagagcgaagtggctctggaggggctctaccaacagttgaccgtgcgtggccgtgccgatggctatgatccggatcgcaatgtgctggaagaggtcaagacctaccgtggcgacctggctgcccagccggccaaccaccggcaactgcactgggcccaggccaaggtctacggctggctgatgtgcagcacgctggggttgcccgagattggcttggcgctggtgtatttcgatatcgtcagcgagcgcgaaacggtgatcagccaggtttgcacggttgatgaactgcaagcgttcttcaatcgccagtgcgcgttgtttctcggctgggccgagcagcaggcccgccagcgccaggcccgggacgccgcgaccaaggccctggcctttccccacgcaggctttcgcctgggccagcgcacccttgccgagtcggtgtacaaggccgtcagtaccgggcgctgcctgatggcgcaggcccccacggggatcggcaagaccatggggacggtgttcccgatgctcaaggcgatggcgccgcagcagttggacaagctgttcttcctcacggccaagaccccgggccgcaaactggcgctggacgcggtgcaggtgctgcacgccagtaccgacctgccattgcgcgtgctggagctggtggcgcgagacaaggcctgcgagcacctggacaaagcctgccacggcgattcctgcccgctggccaagggcttttatgatcgcctgccagccgcgcgcgaagctgccgccgaggtgcggctgctggatcagcgtcatttgcgcgaggtggcgctggcccacggggtgtgcccctattacctgagccaggaaatggcgcgctggtgcgacatggtggtcgccgactacaactattactttgattttggcgccatgctgtttggcctggcccagctcaaccaatggcgggtcgctgtgctggtggacgaagcccataacctggtggagcggggccgctcgatgtacagcgccgaccttgatcagtttgccctgaagagcttgcgcgataccgcccccgaaccgttgaaaaaaccgttgcagcggctcaaccgagaatggaatgcactgcacaaggagcaggtcgcggcgtaccaggcttatgccagcaaaccggacaagctgttgcaggccctggccctgtgcaccagcgccatgggcgagtatttcaacgaccatccgcaggcactcacgggccaactgcaaggcttttacttcgaggccttgcagttcgccaaggtggcggagctgttcaacgagcagtttgtttttgacatcagccagcgcgacccgctggccaggcgccgcttctcacgcttgagcctgcgcaatgtggtcccggctgagtttctccgcccacgcttgacggcggcccgcagcagcgtgctgttttccgcaaccctgagcccccggcattactatgccaacctgctgggtctgccggcggataccccatggatcgacgtggaatcgcccttcgaggctgcgcaactgcaagtgcacatcatcgaccgcatctccacccgttttgtgcatcgccaggcctccctggcgcccatcgtcgcgctgatcgccgagcagtttgaacgtgcgcccggcaactacctggcatttttcagcagctttgattaccagcagcaggtggcgcagttgctggccgaacggtatccgtcgatccccacctggcatcagtcgcggggcatggccgaggccgagcgccaggccttcctcgaccagttcaccgcgcacagccagggcgtggggtttgcagtgctgggcggagcgttcggcgaagggatcgacctgcctggcgcacgcctgatcggggcctttatcgccaccctgggcctggcgcaactcaacccggtcaacgaacagataaagctgcgcatgggcgcgctcttcggtgaggggtatgactacacctacctgtatcccgggatccagaaggtggtgcaggcggcggggcgggtgattcgcacccagcaggaccagggggtggtgatgctgatcgatgaccgttttgccgagcccaaggtgcggtcgctgttgccgcgttggtggtcgctgacctga

SEQ ID NO: 486 - protein, 760 aa, Unknown
  Obtained from environmental sample
MLCALGGAGRLSYTVAVRALCEFTAKAGDLDLRFTPSPSAQEGMVGHRMVASRRSAHYQSEVALEGLYQQLTVRGRADGYDPDRNVLEEVKTYRGDLAAQPANHRQLHWAQAKVYGWLMCSTLGLPEIGLALVYFDIVSERETVISQVCTVDELQAFFNRQCALFLGWAEQQARQRQARDAATKALAFPHAGFRLGQRTLAESVYKAVSTGRCLMAQAPTGIGKTMGTVFPMLKAMAPQQLDKLFFLTAKTPGRKLALDAVQVLHASTDLPLRVLELVARDKACEHLDKACHGDSCPLAKGFYDRLPAAREAAAEVRLLDQRHLREVALAHGVCPYYLSQEMARWCDMVVADYNYYFDFGAMLFGLAQLNQWRVAVLVDEAHNLVERGRSMYSADLDQFALKSLRDTAPEPLKKPLQRLNREWNALHKEQVAAYQAYASKPDKLLQALALCTSAMGEYFNDHPQALTGQLQGFYFEALQFAKVAELFNEQFVFDISQRDPLARRRFSRLSLRNVVPAEFLRPRLTAARSSVLFSATLSPRHYYANLLGLPADTPWIDVESPFEAAQLQVHIIDRISTRFVHRQASLAPIVALIAEQFERAPGNYLAFFSSFDYQQQVAQLLAERYPSIPTWHQSRGMAEAERQAFLDQFTAHSQGVGFAVLGGAFGEGIDLPGARLIGAFIATLGLAQLNPVNEQIKLRMGALFGEGYDYTYLYPGIQKVVQAAGRVIRTQQDQGVVMLIDDRFAEPKVRSLLPRWWSLT

SEQ ID NO: 487 - DNA, 1854 bp, Unknown; identical to SEQ ID NO: 97
  Obtained from environmental sample

SEQ ID NO: 488 - protein, 617 aa, Unknown; identical to SEQ ID NO: 98
  Obtained from environmental sample
  DOMAIN (133)...(265): Lipase (class 3)
  DOMAIN (381)...(398): Hemolysin-type calcium-binding repeat (2 copies)
  DOMAIN (510)...(527): Hemolysin-type calcium-binding repeat (2 copies)

SEQ ID NO: 489 - DNA, 951 bp, Unknown
  Obtained from environmental sample
atgagcatcctggtcgaactgcccgagcggctctatcagcgcgatgcatttgcgacgttcaacgccgcgccgcggttcgatctcgggaccgcgcgggcaatggcgtggatgtcgcagctcgcctacgaaagcgatcccgaaaagatcgcaaggatcgccgggctgtgggagctacgcaatgtccgcgtactggccagtccgaggacgctcgaccagccactcgtccgcacgcggggtctcgtggccgaggggcatggcgcgacgttcgttgccttcgccggcaccgatccgttggtgccggccaactggttcaccgatttcgacttcaagctgatccccggcatggcgctgccaggtaccgaagtgacgcccggcagcgtgcaccgcggcttcgagcgcggcgtcgccgcggtatgggaccagatcgtcgcggcgctcgccgcccgccctgggacgcccgtcctcatgaccggccacagtctcggtgcggcgctcgccgcagtcgtcgccgaccgcgcgctctcggatgataaggtcaacatgcgcgccagcggcgtgtattgcttcggcatgccgcgcattggcgacgaggatttcgcgctgcgctacaacgacacgctcggccccgccacctatcgcctcgtgcatggcgacgacatcgtcgcgaccgtgccgccgtcccgcctcggcttccgccatgtcggcaagctcgtccgctgtccccgcgccggccgcttcggcgccgacgtgccggcggacttcggagacgacccgcccttcgccagcacactgaagacgggtctgcaccagggcttgagcgatctgttcaagctgcaactgcagccgacatttcgcgacgatccgctgggacgcatgtcgggactgctggcgccgccgatcgcggaccatctgccggaccgctactggagcgcattcggcaacgggggttaa

SEQ ID NO: 490 - protein, 316 aa, Unknown
  Obtained from environmental sample
  DOMAIN (85)...(229): Lipase (class 3)
MSILVELPERLYQRDAFATFNAAPRFDLGTARAMAWMSQLAYESDPEKIARIAGLWELRNVRVLASPRTLDQPLVRTRGLVAEGHGATFVAFAGTDPLVPANWFTDFDFKLIPGMALPGTEVTPGSVHRGFERGVAAVWDQIVAALAARPGTPVLMTGHSLGAALAAVVADRALSDDKVNMRASGVYCFGMPRIGDEDFALRYNDTLGPATYRLVHGDDIVATVPPSRLGFRHVGKLVRCPRAGRFGADVPADFGDDPPFASTLKTGLHQGLSDLFKLQLQPTFRDDPLGRMSGLLAPPIADHLPDRYWSAFGNGG

SEQ ID NO: 491 - DNA, 987 bp, Unknown
  Obtained from environmental sample
ttgaggttttttgccattcatcttttgctcataggttcagttattctttccggctgtcagaccgcacagaacagtaaagtcattgccggtgcttttaacctgaccacaggcttgcagcaaaaagtgatggatcattatgcgcctggtgcggttatcgtccagcaaaatattacctatgcgccacagcagaaattatctctggatctgtatcagccgcagaatattgccagtattggaccaagaccgaccattgtctggattcatggcggcggctggatttcaggttctaaagaacatgcacggggttatttcaagctgctggcggcacagggctataatgtggtatccgtgcaatatcagtttgcgccacaagcgacctatccaagccagttacaccagatcaatcaggcacttgaatttctcgatacctatgcagacacctaccaaatcgatgcccagaacttatatctggccggagattctgccggggcgaatatggccagccattacgccgcgcttttgaccaatcctgtatttgccgaccaatctggtattcagcctcatctgcaacctgctcagcttaaaggtttaatcttgcattgtggaatttatgacttggaagcatttgccagcaaagcacctgaagaaatgaaaattatcgaatggggtgtctttaacctgattcaggcttataccggcgagcgtaaacatgatgccgcatttttaaagcagatttctccgattcagtatattacgccgtcttatccacctgtcctgatcagtggtgggaataaggattttttgaccgatactcagtcactaccatttgtaaaagctttgaaggaacagcaggttgctgtgactgaaatattttatccagagtctaaggcctggctcattcatgaatatcagttttttatggggaaaaaggaaagtcagcaaacctttgtcaaaaccctggattttttacatcagctttcaccttga

SEQ ID NO: 492 - protein, 328 aa, Unknown
  Obtained from environmental sample
  SIGNAL (1)...(22)
MRFFAIHLLLIGSVILSGCQTAQNSKVIAGAFNLTTGLQQKVMDHYAPGAVIVQQNITYAPQQKLSLDLYQPQNIASIGPRPTIVWIHGGGWISGSKEHARGYFKLLAAQGYNVVSVQYQFAPQATYPSQLHQINQALEFLDTYADTYQIDAQNLYLAGDSAGANMASHYAALLTNPVFADQSGIQPHLQPAQLKGLILHCGIYDLEAFASKAPEEMKIIEWGVFNLIQAYTGERKHDAAFLKQISPIQYITPSYPPVLISGGNKDFLTDTQSLPFVKALKEQQVAVTEIFYPESKAWLIHEYQFFMGKKESQQTFVKTLDFLHQLSP

SEQ ID NO: 493 - DNA, 1215 bp, Unknown
  Obtained from environmental sample
atgaagtacattgtcattctaaagaaaggttacaatagagattcacttacagactattgcacaaaagtaggcaagccgtgtgagctacacaatctcgttatcattaacactgacgagtgtacggcaaagattattgctgacttagattgtgtggaatctattgagaaagattctgtatgtacatctgatgaggaattttacaagtcatctcgtactactgataattgggcattgacacgattcaattttacagaacctcaacgagagtatcctgagagttaccgttacaatcgcacaggcaaaggtgttggcatctacgttattgacagtggtgtacgtactactcatcaagagttagtaggacgtgtagaaactatctacagtacccttgaaggtaagcattttgacagtgataatgagctaaacattaaccgtagtcatggtacagccgtagcgtcagcagcagcagggaagaagctaggtattgcaagtgaagctactgtctacaacttattcgtagatttttctatgtcagacattatcaaagcgtttgatactgtattgcaccattacaaaaagtctaagagtgctgctgtacttgtgacatcattctcaactttgtcactagcaatgaaacctatctcagacgcactctaccaagcaggtctcgttcatgtatctagtgcaggtaatcagtctacagatactccaagataccctgctgcattccctcagactatctctgtaggtgctactgacaagcaggacaataaagcatcattcagtaactttggcaataccgtagacgtatatgcacccggagtgaatgtgaaggtagcggatcatgcaagagatgttcgtactcgtattgcaagaggaacctcattctctgcaccttatgttgctggtatcattgcactcatgctagaaggctcagacaagcctcgtaagagtgagcatgtcgataccatacgacaatccttcctagacaatgctgcaagtgcctctaaggcagataagcgtgtgccacatacacgttttgacattgaaccattcaagtttcctaaaccttctcctgtagaaaaaattgtacaaaaggtgtctgacaataaggaatcgtcaactatttcagacaaaggttctaagaagaattacgtcaaagaaattgtagcaggtgttatcctagtagctactatagctgcaattcttctgtaa

SEQ ID NO: 494 - protein, 404 aa, Unknown
  Obtained from environmental sample
  DOMAIN (85)...(345): Subtilase family
MKYIVILKKGYNRDSLTDYCTKVGKPCELHNLVIINTDECTAKIIADLDCVESIEKDSVCTSDEEFYKSSRTTDNWALTRFNFTEPQREYPESYRYNRTGKGVGIYVIDSGVRTTHQELVGRVETIYSTLEGKHFDSDNELNINRSHGTAVASAAAGKKLGIASEATVYNLFVDFSMSDIIKAFDTVLHHYKKSKSAAVLVTSFSTLSLAMKPISDALYQAGLVHVSSAGNQSTDTPRYPAAFPQTISVGATDKQDNKASFSNFGNTVDVYAPGVNVKVADHARDVRTRIARGTSFSAPYVAGIIALMLEGSDKPRKSEHVDTIRQSFLDNAASASKADKRVPHTRFDIEPFKFPKPSPVEKIVQKVSDNKESSTISDKGSKKNYVKEIVAGVILVATIAAILL

SEQ ID NO: 495 - DNA, 447 bp, Unknown
  Obtained from environmental sample
atggacaatgtaaaggttgtattttcaacgagcagagggattgtaagccgagccatacgcaagttcacatggtcggactggtctcacgttggataccttacacccaaccaaactgttattgattctactttcatgcttggtgttgcagaaaaaccatttgaagaatgggttaatgactacagtaaaaccgaaatactctctatacctcatagagaccccggcgagtttgattatacaattcgtcagcaaatgggtaaaccttacgactttggtggtgtatttggtttcattgctcgatcaggaaaatggaatgacccggataggtggttttgtagtgagttaattgcggatacattcgataaatcgggaggcgtagagtttcctaaaggtttatataagattagtcccgcgctactttacacaatgttgtggatgataaaagagtaa

SEQ ID NO: 496 - protein, 148 aa, Unknown
  Obtained from environmental sample
MDNVKVVFSTSRGIVSRAIRKFTWSDWSHVGYLTPNQTVIDSTFMLGVAEKPFEEWVNDYSKTEILSIPHRDPGEFDYTIRQQMGKPYDFGGVFGFIARSGKWNDPDRWFCSELIADTFDKSGGVEFPKGLYKISPALLYTMLWMIKE

SEQ ID NO: 497 - DNA, 876 bp, Unknown
  Obtained from environmental sample
atgttccgcgagacccggccggcgtcgacgccgacgccgccggcgatcggcgccgtccgcgacgagatcgccgagacggcctccggttcgatcccgctgcgcgtgtaccggccggccagcgtggcgtcggacgcgaccctcccggggctggtctacttccacggcgggggctgggtgatcggggacctcgacacgcacgacgtgctctgccgtcagctcaccgccggggcggggctcaccgtcgtctcggtggactaccggctcgctcccgagcacccgtttccggctgcggtcgacgacgcctgggcggccacgcgctgggtcgtcgagcgcgcggaccacctggggatcgacgcgcgccggcttgccgtgggcggggacagcgccggcggcaacctcgccgccgtgacgacgctgctcgcgcgggacgcgggggcgccgtcgatcgcctaccaggtgctgctctaccccgtgaccgacgtcgccgccgaggcgccgtcgtacgacgccttcgccgacggctacctgctgacccgcgccggcatgcgctggttcatcgagcactacctgccgtcccggcgcgacgccgccgactggcgcgtctcgccgctgcgcgccccctcgctcgcggggctgccgccggccctgatcgtgaccgccgggttcgatcccctctgcgacgagggcgaggcctacgcgcgcgcgctccgcggtgccggcgtccgcgtggactacgtccgctatggcggcatgatccacggcttcgtgcccatgggccgcctcatcgagacgggcaaccgtgctgtcgcgcacatcgccgcctcgctgcgcgacgccctgaccgcgacgggccaggcggcggcgccggtgagataa

SEQ ID NO: 498 - protein, 291 aa, Unknown
  Obtained from environmental sample
MFRETRPASTPTPPAIGAVRDEIAETASGSIPLRVYRPASVASDATLPGLVYFHGGGWVIGDLDTHDVLCRQLTAGAGLTVVSVDYRLAPEHPFPAAVDDAWAATRWVVERADHLGIDARRLAVGGDSAGGNLAAVTTLLARDAGAPSIAYQVLLYPVTDVAAEAPSYDAFADGYLLTRAGMRWFIEHYLPSRRDAADWRVSPLRAPSLAGLPPALIVTAGFDPLCDEGEAYARALRGAGVRVDYVRYGGMIHGFVPMGRLIETGNRAVAHIAASLRDALTATGQAAAPVR

SEQ ID NO: 499 - DNA, 1689 bp, Unknown
  Obtained from environmental sample
atgggactgttcgattacaaaaatgccgacggcaaagcgctgtacagcgatgccatcgccctgacgctgtatgcctacacgccgactggccaagccttgcccggtacaggctggaagccgatcggcgccacggcgctgggctatcagggcaaggtcggggcacagggcacgttcttcggcgagaaggacggcttcaccagcgccgaagccgaagtgctcggcaagtacgacgccgcgggcaagctgatcggcatcggcgtggccttccgcggcaccggcgggctgggttacagcgacaccttcggcgacatgaaaaacaatctgctggctgccattggcccgtcggactacgccactcagtacgcgaaaaacgccttcgacaacctgctcaaatcggtggcggctttcgctgtcgcccacggcattgcggccaaggacgtacttgtcagcggccacagcctcggcggcctcggggtcaacagcgtggcagagttgagcgcgagcaactggggcgggttcttcaaggacgccaactacatttcgttcgcctcgccgacccagagcagcaccggcaccaatgtgctgaacatcggttacgagaacgacccggtgttccgcgtgctcgacggcaccacgttcagcaccgcgtcgatgggcaagcacgacaagccgcacgattcgaccaccgacaacatcgtcaacttcaacgacaactacgcgtccaccgcgcagaacctggtgccgttcagcattgccaatccgctgaactggtcggcccacagctcgctggggtacgccgacggcctgaatcgggtgatcgcgtcgaaattctacggcctgacgcacaaggactcgacgatcatcgtctccaaccttgagcaagcgtcgcggggcaagacctgggtcgaggatctgggccgcagcggcgagccgcacaccggcagcacgttcatcatcggcaccgacagcggcgactggctcaagggcggggcgggcaacgacttcctcgaaggcctgggcggcgatgaccgtttccgtgatgacggcggtttcaacatcctgctcggtggccagggccacaataccttcgagctgcaaaagccgttgcagaacttcagcttcgccaacgacggcgacggcacgctgtacgtgcgtgacgcctacggcggcatcagcatgacccgcgacatcggcgcgctggtgagcaaggagtcgggttcgtggtggggcagcaaggaaatcacctggacggtcaccgccaaaggcctggccaacggtgccgaactgagccagtacaaccattcgctcagcggcggtgccatgggcgacaccctgaaagccaccgccgacggcgactggctgttcggcctggccggcaacgatcacctgcaaagcgacaaggcccacgtgaccttcgtcggcggtgccggcaatgacgtgatgagcgcggtgggtggcaacaacaccttcctgttcagcggcgccttcggcttcgacgcgatcaatggctaccagggcagcgacaaactggtgttcctcggcgtcgaaggcgcggggcagggctacgactacaagcaacacgcgtcgcagtccggcagcgataccgtgctgaagattggcgactttgccgtgacgctgatcggggtcggtgtggctaacctgtcggattcgagtttcgtcttcgcctga

SEQ ID NO: 500 - protein, 562 aa, Unknown
  Obtained from environmental sample
  DOMAIN (82)...(212): Lipase (class 3)
MGLFDYKNADGKALYSDAIALTLYAYTPTGQALPGTGWKPIGATALGYQGKVGAQGTFFGEKDGFTSAEAEVLGKYDAAGKLIGIGVAFRGTGGLGYSDTFGDMKNNLLAAIGPSDYATQYAKNAFDNLLKSVAAFAVAHGIAAKDVLVSGHSLGGLGVNSVAELSASNWGGFFKDANYISFASPTQSSTGTNVLNIGYENDPVFRVLDGTTFSTASMGKHDKPHDSTTDNIVNFNDNYASTAQNLVPFSIANPLNWSAHSSLGYADGLNRVIASKFYGLTHKDSTIIVSNLEQASRGKTWVEDLGRSGEPHTGSTFIIGTDSGDWLKGGAGNDFLEGLGGDDRFRDDGGFNILLGGQGHNTFELQKPLQNFSFANDGDGTLYVRDAYGGISMTRDIGALVSKESGSWWGSKEITWTVTAKGLANGAELSQYNHSLSGGAMGDTLKATADGDWLFGLAGNDHLQSDKAHVTFVGGAGNDVMSAVGGNNTFLFSGAFGFDAINGYQGSDKLVFLGVEGAGQGYDYKQHASQSGSDTVLKIGDFAVTLIGVGVANLSDSSFVFA

SEQ ID NO: 501 - DNA, 1650 bp, Unknown
  Obtained from environmental sample
atgtccaaccccctcgaagacccgctttactacctgcataacttccagcaagtgctcgattggctggggcagcgctatgccgatgtgctggatgacgaagaacagcggtttatggcgcagttcgcccagttgccacaaccggcccaggccttgttggtgcggatggtgatgcgcaagggcgtgcattttcgcgcgagcaagctcaactacggcgagatcggcccgatcgacgtggccgtgcagccgttgctggcccacggctgggtcagcgagcagggcctgctgtcgattgatgaactgtggggccagttgcaaaaaggcgaggtgctgcaggcgttcaagccgtggatcgagcagcccaggggcaagaagtccgactggctgccggatttatccagtcatttcaacgaaccccgtacgtttgcgcagtggtgtcctgcactggacgagcggctttacagcctcacggtgatgggcctgtgtgaccgcctgcgcctgatgttcttcggcaacctgtaccaggactggtcggagtttgtactggcggacctggggatctacacctacgagaaggtcgagttctgcgctgaatcccgggggctgcgccatcgtgacgatgtggatggcctgctgttcctgcaccagtgccaacaggccttcgaggcgggccaggcgctggaggaggtgctggcgcagattgccacgttgagcaccgacaacccctggctggaaaagcgacgggccaagctgctgttccagatcggccagcattgcgaacggctcgccgaactgacgctggccgaagtgatctatcgcggctgtccctatcccggcgcgcgcgcacgcctgatccgggtactggaacgccaggaggatttcgcccaggcgatggccctggccctggaggcccaggccgccccacagagcgcggccgagcagcaacacctgctgcgggtgctgccgcggttgcggcgcaagctgggtgagccggcgcagcccaggcccaagccccaggtgatccagcgcctggacctggaactgccattcccgcaaccgctggcagcggtggagttgtgtgtgcaggcgcacctgggggatcaagaggggccggtgcactacgtggaaaacaccctggtcaactcgctgttcggcctgctgtgctggccggcgatcttcgcgccgttgcccggctcgttctttcacccgttccagcgcgggccggtggatttgcacagtgaggacttccagccgcgccgcgccgagttgtttgccgcctgcctggagcaactgcacgaccagcgctacaaaagcacgatccgccagcgctacgccgaaaaatgggggatccagtcgccgtttgtgttctggaatgtgttgagcgaagaactgctcgaacaggccctcgcttgcttgcccgccgaacatctgcggcactggttcgagcgcctgttgctggacatccgcgccaaccgcgccgggatgccggacctgatccagttctggccggcgcaaaaaacctaccgcatgatcgaagtcaaaggcccgggcgatcgcctgcaggacaaccaactgcgctggctggagttctgtggcgagcaccagatgccggttaccgtgtgttatgtgcgctgggcggagcagggcgcttga

SEQ ID NO: 502 - protein, 549 aa, Unknown
  Obtained from environmental sample
MSNPLEDPLYYLHNFQQVLDWLGQRYADVLDDEEQRFMAQFAQLPQPAQALLVRMVMRKGVHFRASKLNYGEIGPIDVAVQPLLAHGWVSEQGLLSIDELWGQLQKGEVLQAFKPWIEQPRGKKSDWLPDLSSHFNEPRTFAQWCPALDERLYSLTVMGLCDRLRLMFFGNLYQDWSEFVLADLGIYTYEKVEFCAESRGLRHRDDVDGLLFLHQCQQAFEAGQALEEVLAQIATLSTDNPWLEKRRAKLLFQIGQHCERLAELTLAEVIYRGCPYPGARARLIRVLERQEDFAQAMALALEAQAAPQSAAEQQHLLRVLPRLRRKLGEPAQPRPKPQVIQRLDLELPFPQPLAAVELCVQAHLGDQEGPVHYVENTLVNSLFGLLCWPAIFAPLPGSFFHPFQRGPVDLHSEDFQPRRAELFAACLEQLHDQRYKSTIRQRYAEKWGIQSPFVFWNVLSEELLEQALACLPAEHLRHWFERLLLDIRANRAGMPDLIQFWPAQKTYRMIEVKGPGDRLQDNQLRWLEFCGEHQMPVTVCYVRWAEQGA

SEQ ID NO: 503 - DNA, 885 bp, Unknown
  Obtained from environmental sample
atgaaggaaacatatcctgagtatagggttgaaccttttgaattgggtgattctgaaagcaaagtaggttgtcttctttttcacggctacacggggtctcctctggacttgttcccagtggccaagatatgcgaaaagtatgggtggcatgttagggctgttaggcttccgggccatggaagacccattgaagaactaatcaaggtcaagcacactgattggttgcgggctgctgaaaaagaatacgaggaattcgccaaaaacaaggaaagagttattttagttggtcattccttgggtaacgtcttgatttttcatctcgatgtaaagtaccgggaagaaaagaagataaccaatcttgtttctatttcgcccccggttgttattaggaaaggctggatgcttccttttgttggtttggcaaagatatttgttaggcacatagattattctgagattgcgtttaaagacaagaaaataatgcaacacccgttgtatgactacttgaggttcacgtacaagaaatttcctttaggtattattaaggagttagggaaggcggttgagtacggtgtcaagcttgtgcctttgctcgagactgatgtcattgttctttttggtaaggaagatgatgtcgtggatccattgtcgggatacgaaatcttgatgaaagcaaagagcaggcacaagtccttggtgatgcttgagggaatgcatgtgccaatgcttgacattgactataaagcgtttcaagaaagcctgatctcgtatttcaatggcataagcgagaaaaaacttggctttgaagatactttcgacatttttgatttgtttgatgaggccgcccggataactaatattgctcttggtaagctaaaaggttga

SEQ ID NO: 504 - protein, 294 aa, Unknown
  Obtained from environmental sample
MKETYPEYRVEPFELGDSESKVGCLLFHGYTGSPLDLFPVAKICEKYGWHVRAVRLPGHGRPIEELIKVKHTDWLRAAEKEYEEFAKNKERVILVGHSLGNVLIFHLDVKYREEKKITNLVSISPPVVIRKGWMLPFVGLAKIFVRHIDYSEIAFKDKKIMQHPLYDYLRFTYKKFPLGIIKELGKAVEYGVKLVPLLETDVIVLFGKEDDVVDPLSGYEILMKAKSRHKSLVMLEGMHVPMLDIDYKAFQESLISYFNGISEKKLGFEDTFDIFDLFDEAARITNIALGKLKG

SEQ ID NO: 505 - DNA, 1254 bp, Unknown
  Obtained from environmental sample
atgactcacaaaaccaagtcgattgcatcgctttccctcatccttatgctgctggctgtgccgttggcgctggcgtcgtcggtaccggtggccgaaccggaagacgttggcttttccgccgagcggctgcaaaggatacacgagttggtcgaccgccatctggaggcggggagtttcgccggcgctgtcactctggtggcgcggcacggccatattgcgcatttcgaggcccacggcctgatggacctcgaaacgagaaagccgatggcgaaggatgccattttccgcatcatgtcgatgacgaagcctgtggtcggcgtcgccgtcctgatgctgatggaagaaggaaaagttcgcctcaacgaccccttgtcgagattcatacccgagcttaaagacctgaaggtcgctgtcgttcagggcgagagtgcggccggagctgaatctcgcttttacacaatcccggcggaccgtgaaattacggttcgggatctgctgactcacacatccggcttcgtcagcggcggcaccagcaatcgcgaagcccagcgcgccagcggcggcattcgaccgaacgacacgctggccacgtacctgccgcggctggcagcggctccgctcgagttccagccgggaacgcgctgggcctatagcgcggcggcgggattcgacgcgctggcacgcgtggtagaggtcgcctccgggcagaccttcgacgaatttgcgcggcaacgcttattcgaaccgcttggaatgaaggacaccttcttctacgccgccgatccgccggtggaccgctttgcaacgctgtatcgacggactgaaagcggattggagaagcagcaagatccgaatttcatgaacggcacatacctttccgggggaggaggactgttcagcaccgccgaagactatcttcagttcgggcagatgctggtcaatggcggcgagttgaacggaacacggctgctcagtccgaggaccgtcgagttgatgcggtccgtctacgctcccgacagcctgccgggacggccagcgggcgaaggctatggcctgagcgtccgcgtgatcaacgattcgattcaaagagggaccatgctctccgacggcgccttcggttggagcggcgcctttgggacccacttctgggtcgatccgaaggagaaggtcgtcggtatttttatgacccaaacctcgacgccggcaatccggccggatctggagaatgccgtgatgcaggccatcatggagtag

SEQ ID NO: 506 - protein, 417 aa, Unknown
  Obtained from environmental sample
  SIGNAL (1)...(25)
  DOMAIN (46)...(417): Beta-lactamase
MTHKTKSIASLSLILMLLAVPLALASSVPVAEPEDVGFSAERLQRIHELVDRHLEAGSFAGAVTLVARHGHIAHFEAHGLMDLETRKPMAKDAIFRIMSMTKPVVGVAVLMLMEEGKVRLNDPLSRFIPELKDLKVAVVQGESAAGAESRFYTIPADREITVRDLLTHTSGFVSGGTSNREAQRASGGIRPNDTLATYLPRLAAAPLEFQPGTRWAYSAAAGFDALARVVEVASGQTFDEFARQRLFEPLGMKDTFFYAADPPVDRFATLYRRTESGLEKQQDPNFMNGTYLSGGGGLFSTAEDYLQFGQMLVNGGELNGTRLLSPRTVELMRSVYAPDSLPGRPAGEGYGLSVRVINDSIQRGTMLSDGAFGWSGAFGTHFWVDPKEKVVGIFMTQTSTPAIRPDLENAVMQAIME

SEQ ID NO: 507 - DNA, 1854 bp, Unknown
  Obtained from environmental sample
atgggtgtgtatgactacaagaacttcagcacggcggattccaaggcgttgttcagcgacgccatggccatcacgctgtactcctatcacaacctcgacaacggtttcgcggtcggctatcagcacaacggcttcggcctcggcctaccggccacgctgatcagtgcgctgatcggcggcaccgactctcaaggggttattcccggaatcccgtggaaccccgactcggaaaaactcgctctcgacgccgtaaagaaggccggctggacgcccatcactgcgtcgcaactgggctatgacggcaagaccgacgtgcgtggaaccttcttcggtgaaaagcccggctacaccagtgcccaagtggaaatcctcggcaagtacgacgcccagggccatctcacggaaatcggcatcgcctttcgcggcaccagcggcccacgggaaatcctcatcggcgactccatcgccgacgccatcaatgacctgctcgccgcgttcggtcccaaggattacgccaagaactacgtcggcgaagccttcggcaacctgatgaacaacgtggtggcctttgccaaggccaacggcctcaccggcaaggacgtgctggtcagcggccacagcctcgggggcctggcggtcaacagcatggcggacctgagcggcagcaagtggggcgggttcttccaggactccaactacatcgcctacgcctcgccgacccagagcagcaccgacaaagtgctcaacgtcggctacgagaatgacccggtgttccgcgcgctcgacggctcgaccttcaccggggcatcgctgggcgtgcacgacgcgtcgaaagtgtcggccaacgacaacatcgtcagcttcaacgaccactacgcctcgaacgcgtggaatgtgctgccgtattcgatcgtcaacatcccgacctggatctcgcacttgccgacggcttacggcgacggcatgaaccgggtcatcgagtcgaagttctacgacctcaccagccgtgactcgacgattatcgtggccaacctgtcggacccggcgcgggccaacacctgggtgcaggatctcaaccgcaacgccgagccccacaagggcagcaccttcatcatcggcagcgacggcaacgacctgatccagggcggcagcggtaacgattatctggaaggccgtgccggcaacgacaccttccgcgacagcggcggctacaacatcatcctcggtggttcaggcaacaacaccctcgagttgcagcagtcggtgaacaagttcgacttcgccaacgacggcgccggcaacctgtacatccgcgatgccaacggtggaatcagcatcacccgtgacatcggcagcatcgtcaccaaggagccgggcttcctctggggcctgttcaaggacgacgtgacccacagcgtgaccgccgatggcctgaaggtcggcaacaacgtcacccagtacgaatcgagcgtgaagggcaccagcggcgccgacaccctcaaggcccatgccggtggcgactggttgttcggcctggacggcaacgatcacctgatcggtggcgcgggcaacgacgtgttcgtcggcggcgccggcaatgacctgatggaatcgggtggcggtgcggatacgttcctgttcagcggcgcgttcggccaggaccgggtggtgggcttcaacggcaacgacaaactggtgttcctcggcgtgcagggcgtgttgcccggcgatgacttccgcgcccatgccacgtccgtggggcaggatacggtgctgaagtttggcgctgattcggtgacgctggtcggtgtttcgctgagcagtctgaacgccgatggcatcgtgatcgcctga

SEQ ID NO: 508 - protein, 617 aa, Unknown
  Obtained from environmental sample
  DOMAIN (510)...(527): Hemolysin-type calcium-binding repeat (2 copies)
  DOMAIN (133)...(265): Lipase (class 3)
  DOMAIN (381)...(398): Hemolysin-type calcium-binding repeat (2 copies)
MGVYDYKNFSTADSKALFSDAMAITLYSYHNLDNGFAVGYQHNGFGLGLPATLISALIGGTDSQGVIPGIPWNPDSEKLALDAVKKAGWTPITASQLGYDGKTDVRGTFFGEKPGYTSAQVEILGKYDAQGHLTEIGIAFRGTSGPREILIGDSIADAINDLLAAFGPKDYAKNYVGEAFGNLMNNVVAFAKANGLTGKDVLVSGHSLGGLAVNSMADLSGSKWGGFFQDSNYIAYASPTQSSTDKVLNVGYENDPVFRALDGSTFTGASLGVHDASKVSANDNIVSFNDHYASNAWNVLPYSIVNIPTWISHLPTAYGDGMNRVIESKFYDLTSRDSTIIVANLSDPARANTWVQDLNRNAEPHKGSTFIIGSDGNDLIQGGSGNDYLEGRAGNDTFRDSGGYNIILGGSGNNTLELQQSVNKFDFANDGAGNLYIRDANGGISITRDIGSIVTKEPGFLWGLFKDDVTHSVTADGLKVGNNVTQYESSVKGTSGADTLKAHAGGDWLFGLDGNDHLIGGAGNDVFVGGAGNDLMESGGGADTFLFSGAFGQDRVVGFNGNDKLVFLGVQGVLPGDDFRAHATSVGQDTVLKFGADSVTLVGVSLSSLNADGIVIA

SEQ ID NO: 509 - DNA, 1854 bp, Unknown
  Obtained from environmental sample
atgggtgtgtatgactacaagaacttcggtacggcggaatccaaggcgctgttcagcgacgccatggccattacgctgtattcctatcacaacctcgataacggctttgccgtcggttatcagcacaacggcttcggcctcggcttgccggccacgctggtgaccgcgctgatcggcggcacggattcccagggagtgatccccggtattccgtggaatcccgattcggaaaaagccgcactcgacgcggtgaaaaaagccggctggaccccgatcaccgcctcgcaactgggttacgaaggcaagaccgatgtccggggcaccttcttcggcgaaaaggccggctacaccagcgcccaggtggaaatcctcggcaaatacgacgcgcagggccatctcacggagatcggcatcgcctttcgcggcaccagcggcccacgggaaatcctgatcggcgattccatcggtgacgtgatcaacgatttgctcgccgcgttcggccccacggattacgccaggaactacgtcggcgaagccttcggcaacctgatgaacattgtggtggccttcgccaaggccaacggcctgagcggcaaggacgtgctggtcagcggtcacagcctcggcgggctggcggtcaacagcatggcggacctgagcaccagcaaatggggcgggttcttccaggattccaactacatcgcctacgcctcgccaacccagagcagcaccgacaaggtgctcaacgtcggctatgaaaacgacccggtgttccgcgccctcgacggctcgactttcaccggtgcctccctcggcgtgcacgacgcgcccaaggagtcagcgaccgacaacatcgtcagtttcaacgaccattacgcctcggcggcgtggaacgtgctgccgttctcgatcgtcaacattccgacctggatctcacacctgccgaccgcctacggcgacggcatgaaccgggtgatcgagtcgaagttctacgacctgaccagcaaggattcgacgatcatcgtcgccaacctgtcggatcccgcgcgggccaacacctgggtgcaggacctgaaccgcaacgccgaaacccacaagggcagcacgttcatcatcggcagcgacggcaatgacctgatccagggcggcagcggcaacgattatctggagggccgcgccggcaatgacaccttccgcgatggcgggggctacaacgtcatcctcggcggtgccggtaacaacaccctcgatttgcaacagtcggtgaacaagttcgacttcgccaacgacggcgccggaaacctgtacatccgcgatgccaacggcggcatcagcatcacccgcgacatcggcagcatcgtcaccaaggaaccgggctttctctggggcctgttcaaggacgacgtgacccacagcgtcacggcgaccggcctgaaggtcggcaacaacgtcactcagtacgaatcgagcgtgaaaggcaccagcggcgccgacaccctcaaggccaaggccagcggtgactggctgttcgggctggacggcaacgaccatctgatcggcggggcgggcaacgatgtgttcgtcggcggcgccggtaatgatctgatggagtcgggtggcggggcggataccttcctgttcaacggcgcattcggccaggatcgcgtggtgggttacaccgccaacgacaaactggtgttcctcggcgtgcagggcgtgttgccgggcgacgacttccgcgcccatgccacaacggtggggcaggacacggtgctgaagtttggcgctgattcggtaacgctggtcggggttgccttgaacagcctgaatgccgacgggatcgtgatcgcctga

SEQ ID NO: 510 - protein, 617 aa, Unknown
  Obtained from environmental sample
  DOMAIN (510)...(527): Hemolysin-type calcium-binding repeat (2 copies)
  DOMAIN (133)...(265): Lipase (class 3)
  DOMAIN (381)...(398): Hemolysin-type calcium-binding repeat (2 copies)
MGVYDYKNFGTAESKALFSDAMAITLYSYHNLDNGFAVGYQHNGFGLGLPATLVTALIGGTDSQGVIPGIPWNPDSEKAALDAVKKAGWTPITASQLGYEGKTDVRGTFFGEKAGYTSAQVEILGKYDAQGHLTEIGIAFRGTSGPREILIGDSIGDVINDLLAAFGPTDYARNYVGEAFGNLMNIVVAFAKANGLSGKDVLVSGHSLGGLAVNSMADLSTSKWGGFFQDSNYIAYASPTQSSTDKVLNVGYENDPVFRALDGSTFTGASLGVHDAPKESATDNIVSFNDHYASAAWNVLPFSIVNIPTWISHLPTAYGDGMNRVIESKFYDLTSKDSTIIVANLSDPARANTWVQDLNRNAETHKGSTFIIGSDGNDLIQGGSGNDYLEGRAGNDTFRDGGGYNVILGGAGNNTLDLQQSVNKFDFANDGAGNLYIRDANGGISITRDIGSIVTKEPGFLWGLFKDDVTHSVTATGLKVGNNVTQYESSVKGTSGADTLKAKASGDWLFGLDGNDHLIGGAGNDVFVGGAGNDLMESGGGADTFLFNGAFGQDRVVGYTANDKLVFLGVQGVLPGDDFRAHATTVGQDTVLKFGADSVTLVGVALNSLNADGIVIA

SEQ ID NO: 511 - DNA, 1065 bp, Unknown
  Obtained from environmental sample
atgccgcgagcggggctggcctgtgaccacttgcgggagtctgcggtgacatcgacgtcgtcctcggcttcagtcccttccgacggcagcgtccaacgccaggtcgatccagagctgcagcccattctggtgcgcatgctggcgcggatggcagagcggccgccgctgggaacctcgaccggggccgagatgcgggcgcgcttcagcgaggatgtcgcctcctggaacgccgatccgccgccgctggcctgcatcgagaatcgcacggtgcccacggctgcacgcgcggtgccggtgcggatctactcggcagcaccccggaccgagccgcagccggcgatcatcttcttccacggcggtggctgggtggttggcgacctcgattcgaacgagcgcgcgttgcgcgtgctcgccatcgaaagcggggtcaccgtcgtctcggtggactattgcctggcgcccgaaaatccgtttccggcgccgctcgacgaatgcctggcggtaggacgctggatccaccggcacggcacgcaatggggaatcgatgtggaccggctggcattcggcggggattcggcgggcgccaacctgtcgctggctgcggcgctcgacctgcgcgatgcgggcgagacctggttgcgctacctgttgctcatctacggcgcctacgcctgggacagcgatacggagtcgcaccggctgtttggcgacggcgcgatgggatttggtaccgaggcgatggacgcgctgtgggcgatgtacctgggcggacgcgcgcaggcctgcaatccgcgcgccgcgcctttgcatgccgaactccgcggcctgccgcccgctcatgtcgtggccggcggactcgatccgctgcgcgacgacagccggcggctggcggcacggctgatcgaggccggcgtcagcgtcgaataccgcgagtatcccggtgtcgtgcacggcttcatgtcgatgacgcgcgacctgtcggtcgcccggcgcgccacggcttgcgcggccgattctctacgaggcgccctgtcgccgcgcgcgccgacggtcccgcggccgtga

SEQ ID NO: 512 - protein, 354 aa, Unknown
  Obtained from environmental sample
MPRAGLACDHLRESAVTSTSSSASVPSDGSVQRQVDPELQPILVRMLARMAERPPLGTSTGAEMRARFSEDVASWNADPPPLACIENRTVPTAARAVPVRIYSAAPRTEPQPAIIFFHGGGWVVGDLDSNERALRVLAIESGVTVVSVDYCLAPENPFPAPLDECLAVGRWIHRHGTQWGIDVDRLAFGGDSAGANLSLAAALDLRDAGETWLRYLLLIYGAYAWDSDTESHRLFGDGAMGFGTEAMDALWAMYLGGRAQACNPRAAPLHAELRGLPPAHVVAGGLDPLRDDSRRLAARLIEAGVSVEYREYPGVVHGFMSMTRDLSVARRATACAADSLRGALSPRAPTVPRP

SEQ ID NO: 513 - DNA, 900 bp, Unknown
  Obtained from environmental sample
atgagtccggcgacgcgacagcagggctcgtccgcgcttcagctccgattctggaaggggcaggcgctcggcaacgattacttgatcgtcgatcgcgccgagctggccggcccgctgtcgccagcgcgcgccatcttgctctgtgaccgccaccgcggcgccggcgccgatggcgtgctcgtcgccgagctcgacacgcgcccgttcggtctccgcatcatcaaccccgacggtacggaagcggaaaagagcggcaacgggcttcgcatcttcggcgcattcctatacggccgctcgctcgtgcggcgcgacgagtggttcgaggttcagctgccgtacgagactgtcgccatgcgcgtcgaagcccagctcgccgccggcgcggtcctcatccgtgcacggatgggcggcgcgcgcttcgacggcgccgccgtagcattcacggcggagcctggcgaagcgagcggtttcgcgctgccgctgccggacggcgacagcgctgtcatccacacggtctcgctcggcaacccgcactgcgtcgtgttcgtcgacgcgctcgaccgcgccgacttcctcgcccgcgcgccgcagctgtgcacgcaccccgcgttcgcgcacggcaccaacgtgcagttcgcgcgtgtggccggcccgcgcgagatcgaagcctggatctgggaacgcggtgcgggcgaaacgctcgcctccggctcgagcgcatgcgccgtcgccgcggccgccgcgcgccgcggcttcgtgcccgttggaccgctcgtcgtccgcatgcccggtggcagcgtcgacatcaccgtccgtcccgactttcacatcgaactgctcgggcccgcccagatggtctacgaggctcgcctgctcgagggcatcgccgccgactggtag

SEQ ID NO: 514 - protein, 299 aa, Unknown
  Obtained from environmental sample
  DOMAIN (17)...(141): Diaminopimelate epimerase
  DOMAIN (170)...(286): Diaminopimelate epimerase
MSPATRQQGSSALQLRFWKGQALGNDYLIVDRAELAGPLSPARAILLCDRHRGAGADGVLVAELDTRPFGLRIINPDGTEAEKSGNGLRIFGAFLYGRSLVRRDEWFEVQLPYETVAMRVEAQLAAGAVLIRARMGGARFDGAAVAFTAEPGEASGFALPLPDGDSAVIHTVSLGNPHCVVFVDALDRADFLARAPQLCTHPAFAHGTNVQFARVAGPREIEAWIWERGAGETLASGSSACAVAAAAARRGFVPVGPLVVRMPGGSVDITVRPDFHIELLGPAQMVYEARLLEGIAADW

SEQ ID NO: 515 - DNA, 870 bp, Unknown
  Obtained from environmental sample
atgcgcgcggcgctgctcctcgtgctggcggtggcggcggggggctgttcgccgcgcaggatggcggaaggtctgctgctgggcagccagttcgtccgcaccgccgacctgtcctacggcggggatgcgcggcagcggctggacgtgtaccggtcgcgcacggtgcggcagggggtgccggtggtggtgttcctctacggcgggcgctggcagagcggaagcaaggacgagtaccggctgctgggcgacgcgctcacccggcgggggatggtggcggtaatcccggagtaccggctgtacccgcaggtgcgctttcccgcctgggtgcaggacgccgccctggccgtgcgctgggcccgcgacaacgccgcccgctacggcggcgacccggacaacctgatcgtggtggggcactccgcgggcgcgcacacggcggcgctgctggcgctggacgagcgctggctccgagaggcgggagtgccggcgggcgccgtgcgcgggttcgccgcgctggccgggccggtggacacggtgtggacggatgccgacgtgcaggcgctgatggggccggcggagggatggccggcaacgtatcccgccacgcacgtggatgggacggagcccccgcttctgctgctgcacggcgggggcgaccgcacggtttcgaccgggagctcggtgcggctggccgcgcgcatccgggagcgcggcggatgcgcccgcgccatcctctaccccggtgtggggcacgtgcagatcatcgtggcggcggcggtgcccggcgtctcgtccgcgcccgtgctggccgacctgaccacgttcgttgaagatccgcgcgcatttgcgtgcccgggcggacggccccggtga

SEQ ID NO: 516 - protein, 289 aa, Unknown
  Obtained from environmental sample
  SIGNAL (1)...(22)
MRAALLLVLAVAAGGCSPRRMAEGLLLGSQFVRTADLSYGGDARQRLDVYRSRTVRQGVPVVVFLYGGRWQSGSKDEYRLLGDALTRRGMVAVIPEYRLYPQVRFPAWVQDAALAVRWARDNAARYGGDPDNLIVVGHSAGAHTAALLALDERWLREAGVPAGAVRGFAALAGPVDTVWTDADVQALMGPAEGWPATYPATHVDGTEPPLLLLHGGGDRTVSTGSSVRLAARIRERGGCARAILYPGVGHVQIIVAAAVPGVSSAPVLADLTTFVEDPRAFACPGGRPR

SEQ ID NO: 517 - DNA, 930 bp, Unknown
  Obtained from environmental sample
atgaaaaaaacagcacgtatccttaccgttttgagcctgctcgcattatcagttccatctatggcgcaaacagaaaccatgaacctttggccggaaggcaaagtccccaattttaaaaagagtgatgtagaagagaaatcggtcaccgacgcacagggcatcctgcggatcagcggcgtaacggttcctacgattacagcttacattgcaccgaaagataaagcaaccggagcggcggtgatgatctgcccgggcggcggttacggcatattggcggcttcgcacgaaggcagtgattttgccaaatggttcaatgaacgtggtatttcggcatttgtcctgaaataccgcctacccaacgaaaaagcgatggctcatcagcacgaagtcccattaatggacgccatgcagggcatgaaactgatccgccagaatgccggcaaatggggcatcgacgtgaacaaaattggagtgatgggtttttcagcgggcggccacctggcagccacgatttcgacacattacaatatgggtgaaaaagcttcccccgacggcaaaccaaacttttcgatactcatttacccggtgatctcgcttacacccgccctcgcacacggaggctcacgcgacaacttactcggacctgaaaaatcggacgagctgatcaaatactattccaacgaattgcaggtatccgatcagaccccgccggcattcctcgttcacgctatggacgacacgggcgtccccgtcgagaacagcatcgaatattacctggcgctgaaaaagaaaaagatcccggccgaaatgcacttgtacccgaaaggtggccatggctacggcatgcgcaccgaaggtaaaggatctctcggtggttggcccgccgcaatggaaggctggctgaaagcgatgggataccagaaaaattga

SEQ ID NO: 518 - protein, 309 aa, Unknown
  Obtained from environmental sample
  SIGNAL (1)...(22)
MKKTARILTVLSLLALSVPSMAQTETMNLWPEGKVPNFKKSDVEEKSVTDAQGILRISGVTVPTITAYIAPKDKATGAAVMICPGGGYGILAASHEGSDFAKWFNERGISAFVLKYRLPNEKAMAHQHEVPLMDAMQGMKLIRQNAGKWGIDVNKIGVMGFSAGGHLAATISTHYNMGEKASPDGKPNFSILIYPVISLTPALAHGGSRDNLLGPEKSDELIKYYSNELQVSDQTPPAFLVHAMDDTGVPVENSIEYYLALKKKKIPAEMHLYPKGGHGYGMRTEGKGSLGGWPAAMEGWLKAMGYQKN

SEQ ID NO: 519 - DNA, 1197 bp, Unknown
  Obtained from environmental sample
atgaaatatgaaaataattatccatgtcttttcatacatggtcttgcagggtatggtgaccaagattttctcgataagtttttaagttactggggacctggttctaggaatcttatgaagcatctaagaaaacagggaatcgaatgttataaccctacacttggaccttttgatggtgcatgggatagatgctgtgaactctatgcttatatttatggtggcacagttgattatggtaaggtacacagtcgaaaacatcatcataaacgttatggaagaacctatgcacatggtgttttggaggatcttggtaaaactgaagctcataaaaaggtaaatctttttggtcattcttttggtgcccctactgtaaaacagtttatacatcttttaataaatggatcagaggaggagcgtgcagccacaccagaagaagaactgaatcctctttttaaaggtgggcagggcgatattattcatactgtgaccacactctctggtgttaataatggaacagctcttgcaaacttttttggacctaaatctcgaagtgtaattgtaggaactctttttatgtttaattcacttcttaaggatactcagttccctaaactttgggacttccattttcaaaaatggggtgttatggatttgcctgagaatatacatacacataaactttccaatccattggaaggacttaagggttcaaagatttactgtttaaataagattgataatattgcatatgaaatgcgagtagactatgtacaggacgtaattaatccttctcaaacaatgtcagaagagatttattatttctgtcagagagcttgtaattcatatgaaacctttgatggttatcagcttcctcatttaaaaggaaatccagtgtgtactttacctggatatattacaggttggttccatcctaataatttgaaaaagtatggtgtagataaaagctggcttccaaatgatggtttcgttaatgtaaagggacaaggtgctccttatggttgtccttatgaagatggagaaattggcaagaccgatttcaaaccgggaatttggtacaatcttcctgtaataaaaggagatcatttagtttggaatggaatgagtggtaaaaagagagaccattttgaacgttacgacaaaatgattcatttgtttagaactcttcctgacgcataa

SEQ ID NO: 520 - protein, 398 aa, Unknown
  Obtained from environmental sample
MKYENNYPCLFIHGLAGYGDQDFLDKFLSYWGPGSRNLMKHLRKQGIECYNPTLGPFDGAWDRCCELYAYIYGGTVDYGKVHSRKHHHKRYGRTYAHGVLEDLGKTEAHKKVNLFGHSFGAPTVKQFIHLLINGSEEERAATPEEELNPLFKGGQGDIIHTVTTLSGVNNGTALANFFGPKSRSVIVGTLFMFNSLLKDTQFPKLWDFHFQKWGVMDLPENIHTHKLSNPLEGLKGSKIYCLNKIDNIAYEMRVDYVQDVINPSQTMSEEIYYFCQRACNSYETFDGYQLPHLKGNPVCTLPGYITGWFHPNNLKKYGVDKSWLPNDGFVNVKGQGAPYGCPYEDGEIGKTDFKPGIWYNLPVIKGDHLVWNGMSGKKRDHFERYDKMIHLFRTLPDA

SEQ ID NO: 521 - DNA, 1188 bp, Unknown
  Obtained from environmental sample
atgaaatcgataacatattacaaccaatatccaactgtgtttattcacggatttactggatttggacctgacaacggacttaaccgatattaccgttattggggttcgtttaccaaagaccttatgaaggaacttggcaaaagaggatatgaagtatacaacccatctcttggaccgtttaactccatgtgggatcgttgctgtgatttatatgcctatctttttggcggaacagctgattatggcaaggttcacagtgagaagaatggtcatgcaagatatggaagaacctatccaggagtacttaaggatcttgggggagaaggaaatcataaaaaattcaatcttgttggtcacagctttggaggaccgactgtttgtctgttttctagtctattatattcaggggcacaggaagaaattgatggaactcctgaagaggaactttcacctctattcaaaggtggacatggcgagttactacacacagtaactacactttctggtactaataatggtacttcccttattgagtttattggtgaaccgctacagaagttatgtggttctgcattgatgactatttgtgctactctttcggaaactaaggctatgcagttttatgattttaaaaccgatcattttggaataatgggtaattctgcagatattaaagaaaacaaacttacaaatcctattagtaagtggagcgaaattagagcatatgcagaaagtgatgacaatatttttaaagagatgggtgtagaattctctagaaatatggcggaaaagtattatgagatgataccgtcggtttattattttgcaagaagggcatgtagaactcatactcttccaagtggtagacatatgtttaatgtaaatatgaatccacttttttatttaacttcgcctattattggaagatataaaaataaaagacatggaattgatgaaagttggttccctaatgatggctgcgttccaattagaggtatgaatcctccagagaatatgccacaagtagaatggatagagggtatgacttttgaatctggtctttggcatacaatgcctatagaggacaaggaccaccagtcttttgctggtatgctcgaaccacgttttaaatattttaactattattcagatatgttagaacttttccgcacattgcctgatgcttga

SEQ ID NO: 522 - protein, 395 aa, Unknown
  Obtained from environmental sample
MKSITYYNQYPTVFIHGFTGFGPDNGLNRYYRYWGSFTKDLMKELGKRGYEVYNPSLGPFNSMWDRCCDLYAYLFGGTADYGKVHSEKNGHARYGRTYPGVLKDLGGEGNHKKFNLVGHSFGGPTVCLFSSLLYSGAQEEIDGTPEEELSPLFKGGHGELLHTVTTLSGTNNGTSLIEFIGEPLQKLCGSALMTICATLSETKAMQFYDFKTDHFGIMGNSADIKENKLTNPISKWSEIRAYAESDDNIFKEMGVEFSRNMAEKYYEMIPSVYYFARRACRTHTLPSGRHMFNVNMNPLFYLTSPIIGRYKNKRHGIDESWFPNDGCVPIRGMNPPENMPQVEWIEGMTFESGLWHTMPIEDKDHQSFAGMLEPRFKYFNYYSDMLELFRTLPDA

SEQ ID NO: 523 - DNA, 1335 bp, Unknown
  Obtained from environmental sample
atgactactaaaatctttttaattcacggatggtctgtcaagacaacacaaacatatcaggcgctgcaccttaagttggcagagcagggatatcagctggaagatatttacctcgggcggtatctgtcccttgaaaatcatatcgaaatacgggatattgcaaaagcaatgcaccgtgcattgctggagaggattaccgactggagtcagcctttccattttattactcacagtacgggaggtatggtcgccaaatattggatattgaatcattataaaggaagtattgcaaaacaaaaaccactcaaaaatgtagtgtttctggctgcacctaattttggttcaaggctggcacaccatggacgtaccatgctgggagaaataatggaactgggagaaacagggaagaagattcttgaatctctggagttaggaagtgctttttcgtgggatgtgaatgagcagttttttaatgcgtccaattggaaagataaagaaataaagttctataacctgataggagacagggtcaaaacggatttttttaaatccaaaatttttccagctgcgtttgaaagcgggtcagatatggtgattcgggttgcggcaggaaatcagaactttgtccggtacaggtacgatagtcagaaagatagctttactgttgtcaatgagttgaaaggaattgcttttggtgctctctaccaatatacacattccaatgatgattatggaatcctgaacagcatcaaaaaaagttcaacccttgaaaaccatcaggcactcagactaattgtagaatgtctgaaggtttcgggagataaagaatatgaaaatgttgttgcacagttggctgcagcgacaaaagaaaccagagaaaaacgccagggatatgcacagctggatttccgttttcgggatgatgaaggctttccaatagatgattatgttgtagagctgggagtaatggtaaatggaaaacctaaaccatctaaaacagtagatgacgtgcataagaataaaattacaccaaaccatcttactgtattcattaacctgaaagaactggaacctaatctgaagtactttatcaatattaaatcgatatcggaatcctccatgtatagttacgatcctgctgtcaggactatagagcttgcttctaacgagattacaaaaattatccgtgaggaccatacaacacagattgatgtgatactttcccggactcctgctaaaaaccttttcatgtttcatcgcggagatgatgaagacctacatgtgacatggtcgcggtacggagaaacaaaaagtacaaagcagggaataaaataa

SEQ ID NO: 524 - protein, 444 aa, Unknown
  Obtained from environmental sample
MTTKIFLIHGWSVKTTQTYQALHLKLAEQGYQLEDIYLGRYLSLENHIEIRDIAKAMHRALLERITDWSQPFHFITHSTGGMVAKYWILNHYKGSIAKQKPLKNVVFLAAPNFGSRLAHHGRTMLGEIMELGETGKKILESLELGSAFSWDVNEQFFNASNWKDKEIKFYNLIGDRVKTDFFKSKIFPAAFESGSDMVIRVAAGNQNFVRYRYDSQKDSFTVVNELKGIAFGALYQYTHSNDDYGILNSIKKSSTLENHQALRLIVECLKVSGDKEYENVVAQLAAATKETREKRQGYAQLDFRFRDDEGFPIDDYVVELGVMVNGKPKPSKTVDDVHKNKITPNHLTVFINLKELEPNLKYFINIKSISESSMYSYDPAVRTIELASNEITKIIREDHTTQIDVILSRTPAKNLFMFHRGDDEDLHVTWSRYGETKSTKQGIK

SEQ ID NO: 525 - DNA, 795 bp, Unknown
  Obtained from environmental sample
atgagcgtcgaggtccgcgggagcggccccgacgtggtgctgatccccgggctcgcctcctcgccggaggtctggcaggcgaccgcggaccggctcgacgacacccatcgcgtacatctggtgcaggtgaacggcttcgccggcgcgcccgccggggcgaacgccgaaggcgcggtggtcgcgccgctggtcggggagctgaaccgctacatcgccgagaccgggctgaagcggccggccctgatcggccactcgctgggcggcttcgcggcgctgcggttggcggccgagcatccgcaggcggtgggccgcgtgctggtggtggactcgctgcccttcttcccgctgctgttcagcccggcggcgactgtggaggcggtgaccccgcaggcgaacgccatgcgggacggcatgctggccatgccggccgagcgcttcccggcggtgcaggcggccgggatgggacggctggtcaagaaccccgaagcacgcagcaagcacgtccgcatcggcggcgcctccgaccctgcggtggtcgcgcgcgccatgcacgagatcatgaccaccgacctgcggccccagctgcgcgggatcgttgcgcccgtcaccgttctctacgcctgggaccccgccatgggactcacggtcgaggcctacgaccagctctggcgcggcgcctacgccggactgaagggggcgagcctgacgcgggtggacggcagcttccacttcatcatggacgaccagccggagcgcttctccgcggaggtcgagcggttcctggcggccgagtaa

SEQ ID NO: 526 - protein, 264 aa, Unknown
  Obtained from environmental sample
  DOMAIN (36)...(259): alpha/beta hydrolase fold
MSVEVRGSGPDVVLIPGLASSPEVWQATADRLDDTHRVHLVQVNGFAGAPAGANAEGAVVAPLVGELNRYIAETGLKRPALIGHSLGGFAALRLAAEHPQAVGRVLVVDSLPFFPLLFSPAATVEAVTPQANAMRDGMLAMPAERFPAVQAAGMGRLVKNPEARSKHVRIGGASDPAVVARAMHEIMTTDLRPQLRGIVAPVTVLYAWDPAMGLTVEAYDQLWRGAYAGLKGASLTRVDGSFHFIMDDQPERFSAEVERFLAAE

SEQ ID NO: 527 - DNA, 1095 bp, Unknown
  Obtained from environmental sample
atggaattgaaatataacagattaacaatcaatattcttcggtttgtggttgctctcttgttcctaacaattgcgtggttaatgctgtgctcaaatcaacaagatcgcacagattccagagctgcgatccaaacggaaactcagtacccgttaactgaaaacctgatcagtaatataatggagcagtctccggatcaactgatgctttctcaggatcaagaaccaaagatcactattttacagttaccggggtctttacgtgattctgtgttgccttcatcacttgatgtcagtgtcgatggtgatttggtgatcaacaagaaggttcagcatctatttgatttttatctatctgctttgggtgaggaaagcctggaggttgttgttgctcgaattaagcaaagacttgaactacaacttaagccaccggcattggaacaggcctctgatattttaactgggtatgtacaatatctgaatgagataacggcgataaagcagcaatatgagcaagatttaaagggagaatatacccttgaaaatgtaatcaatgcgcgcagactggttttagatgcccgggctgagtttttagcaccagaggttattgttgtgttttttgaacaaactgaccaatacgaagagtatatgctaggccttgccgctgttacgcaaaatagtgagttaacccaagtacaaaagcagcagactaaagcagagcttgatgcgactgctcctgagtggttgttggcgcaacagcagaatgcaaatcagctaaatgactatcgaagtcaatatcaagagctaaaatcgcaaggtgccacagaagatgaattgagagacttcactcagcagcagttttcacctgaagcggcagagcggctcgcagatcttgaggagcaacggcagcagtggcagctaaggctggatgaataccgagttgaattaggcggcatcataacaacggatatggttgatcagcaacaacaagaacagatagagcagttgcgcgagttatatttttctgagcaagagattaagcgggttagggtattggataatgccttttttactttgaaaagcaccactttagagtga

SEQ ID NO: 528 - protein, 364 aa, Unknown
  Obtained from environmental sample
  SIGNAL (1)...(33)
  DOMAIN (75)...(357): Proteobacterial lipase chaperone protein
MELKYNRLTINILRFVVALLFLTIAWLMLCSNQQDRTDSRAAIQTETQYPLTENLISNIMEQSPDQLMLSQDQEPKITILQLPGSLRDSVLPSSLDVSVDGDLVINKKVQHLFDFYLSALGEESLEVVVARIKQRLELQLKPPALEQASDILTGYVQYLNEITAIKQQYEQDLKGEYTLENVINARRLVLDARAEFLAPEVIVVFFEQTDQYEEYMLGLAAVTQNSELTQVQKQQTKAELDATAPEWLLAQQQNANQLNDYRSQYQELKSQGATEDELRDFTQQQFSPEAAERLADLEEQRQQWQLRLDEYRVELGGIITTDMVDQQQQEQIEQLRELYFSEQEIKRVRVLDNAFFTLKSTTLE

SEQ ID NO: 529 - DNA, 918 bp, Unknown
  Obtained from environmental sample
atggcatatgatcggaagcttccctgggccctggtgctctcggggggaggagcgaaagggcttgcccatgtgggggtcttaaaggttcttgaagctatggatgtgccgtccccctcgcttattgtgggaacctccatgggggctattgtaggggggctctatgcctgtgggtatcgggctacagaactagaagaaatcgcctttcgctttgatattcgggactatcttgatagcaaggtgttccgtatggaagggcccctggggaagcttatgcaaacgggccagattattggccggcttgccacaaaacccgggatcgattcggggaaggcgattttttcttatcttgaaaaacttaccgaggggcgtggggtggaagagacccgtatcccctttcgctgtaacgcggtggatctggtatcgggtcgggaaatcgttttttcccggggaccccttgctctggcgctgcgggcatctatggcctttccgaccttctttgatccggtctacatggacgacatggtgctggtagatggggggcttgtgaataacctggctatctccgtggctcgaaggcggggctttacccatattcttgcggtggatgtgggtatgtttaccctttcccaggctaccaagctccagaccggtccccagatcctctatcggtgcctcgaagtagtagggcatcatatctatcggggagacatggatcgggcaagccttacccttcagccccgggatgatacgagcccctttgcctttgcgcgggctgcccatcttattcggttaggagagcaaactaccctggcccagcgggaacttctcgagcgcttctttacgccagggtggctcaagcggcttacccttcaacgtcaggtgcaacgggtggggaaaatggtccccgccggggagtga

SEQ ID NO: 530 - protein, 305 aa, Unknown
  Obtained from environmental sample
  DOMAIN (11)...(191): Patatin-like phospholipase
MAYDRKLPWALVLSGGGAKGLAHVGVLKVLEAMDVPSPSLIVGTSMGAIVGGLYACGYRATELEEIAFRFDIRDYLDSKVFRMEGPLGKLMQTGQIIGRLATKPGIDSGKAIFSYLEKLTEGRGVEETRIPFRCNAVDLVSGREIVFSRGPLALALRASMAFPTFFDPVYMDDMVLVDGGLVNNLAISVARRRGFTHILAVDVGMFTLSQATKLQTGPQILYRCLEVVGHHIYRGDMDRASLTLQPRDDTSPFAFARAAHLIRLGEQTTLAQRELLERFFTPGWLKRLTLQRQVQRVGKMVPAGE

SEQ ID NO: 531 - DNA, 1308 bp, Unknown
  Obtained from environmental sample
atgaggaaccgcctcgctttagccgccctgtttccggcccttctcctcctcgcgcccgccgcgcccgccgaggcgcccgcggcgcgggtggcggcgccgcggacgctgagcttcgccgcgaggccggaggaggtcggattcgacggcgcgcgcctgaagcggctcaaggactatgtcgccgcctcggtcgcggacgggaagctggcgggggcgacgacgctcgtcgcgcgcaggggcaggatcgtcgccttcgacacctacggccgcaggaccgccggcggcgcgccggtcactcgcgacaccatcttccgaatctattcgatgtccaagccggtgaccggcgtcgcgctgatgatgctgctcgaggagggcaagttccgcctggacgatccggtgacgatgcacatacccgagttcaaggacctcaaggtctcgacgagcttcgacgcagagggcaggccggtcctggaggagatgaagcggcccccgacgatccgcgagctgatgagccattcggccggcttcggctacggcctcggcgccggctcccccgccgacaatctctaccgtgagatcgacccgctgaacgccgggagcatgaaccagttcatcgagcgcgcggcgcggctcccgctcctcttccagccgggcacgcgctaccaatattcgctctccgtcgacatccagggctatctcgtcgagaagctgtcggggaagccgttcgggcggttcctggaggagcgcatcttccggccgctgcgcatgaaggacaccggcttttacctccgccgcgaccagcttccccgcctcgccggcctctacgtcggcggcgcaagcggcggtcttcaggaggcgcagcaggtgttcggctggccgcgtcccgacccgctgcagccgcccggcttcgagtccggcggggcgggtctcttctccacgacgatggactatgcccgcttctgccagatgctgctgaaccgcggcgagctcgacggcgtgcgcatcctttctcccgcctcggtggcgctcatgtcctccaacgctctgccggaggacgtggcgaaggccggcttcggccgcggccgcggcttcggcctcaacttcgaagtcctgaccgaccccgccgccgccggcagccttgccggcaagggcagctaccgctggggcggcgccgccggcacctggttctggatcgacccgaccaacgaggtgattttcgtcggcatggtgcagcgcctcgattactggaagcccgaccacccgaacgtcatgtcgaccaacctcacctatcaggcgctgacgcggccttga

SEQ ID NO: 532 - protein, 435 aa, Unknown
  Obtained from environmental sample
  SIGNAL (1)...(23)
  DOMAIN (55)...(427): Beta-lactamase
MRNRLALAALFPALLLLAPAAPAEAPAARVAAPRTLSFAARPEEVGFDGARLKRLKDYVAASVADGKLAGATTLVARRGRIVAFDTYGRRTAGGAPVTRDTIFRIYSMSKPVTGVALMMLLEEGKFRLDDPVTMHIPEFKDLKVSTSFDAEGRPVLEEMKRPPTIRELMSHSAGFGYGLGAGSPADNLYREIDPLNAGSMNQFIERAARLPLLFQPGTRYQYSLSVDIQGYLVEKLSGKPFGRFLEERIFRPLRMKDTGFYLRRDQLPRLAGLYVGGASGGLQEAQQVFGWPRPDPLQPPGFESGGAGLFSTTMDYARFCQMLLNRGELDGVRILSPASVALMSSNALPEDVAKAGFGRGRGFGLNFEVLTDPAAAGSLAGKGSYRWGGAAGTWFWIDPTNEVIFVGMVQRLDYWKPDHPNVMSTNLTYQALTRP

SEQ ID NO: 533 - DNA, 948 bp, Unknown
  Obtained from environmental sample
atgagcgacccctatgtgaggcccgacgtccgcctcttcctggattattacaacaagcttcccgggccgcgcgcccatgaagtcgggccgaaccaggcgcgggccatgatcctcgcctcgcgccacgtcgccgacgcggaggcgggcgagctggcggtgatcagggaccttgcctgccccggcccggccggggtgacccgccttcgcctgtacgacgccagggagactcgcgaggcgggtccgctcctcctcttcttccatggcggcggcttcgtcttcggcgatctcgacactcacgagccgttctgcgccgaagtggcgcgtcaactcgatctgccgctgctcgcggtcgactataggctggcgcccgagcaccccttcccggccggtgttgaggattgcattgcggcggcgcgctgggcggcggcaagccccccttccctcggccggcaggtcaccggcctcgtcaccgcgggcgacagtgccggcggcaatttcgcgatcgtcgtcggtctcgcgctccgcgacgagcccgccgacgttccggttatcgcgcaatggccgatctacccggccgcggatcccggcaaaagctatccctcctataaggatttcggcgagggctatttcctcagccacgtcgggatggcgtggttcgacgggtgctacaggcccgacaaggccgactggcgctactcgccacttctcaagagccaggtcggaatgccgcccacgctcgtccagaccgcgagcctggacccgatccgcgatcagggccgcgcctatgccgcggcctgcgcagaggcgggggtgccggtcgtcttccgcgaggccgaaggcaacatccacggctatatcaacctgcgcaaggcgatcccctcctccgccgacgacatcgccgcgggcgtcgaggccctgaagatgatcctgaaggcggtgaaggcgtga

SEQ ID NO: 534 - protein, 315 aa, Unknown
  Obtained from environmental sample
MSDPYVRPDVRLFLDYYNKLPGPRAHEVGPNQARAMILASRHVADAEAGELAVIRDLACPGPAGVTRLRLYDARETREAGPLLLFFHGGGFVFGDLDTHEPFCAEVARQLDLPLLAVDYRLAPEHPFPAGVEDCIAAARWAAASPPSLGRQVTGLVTAGDSAGGNFAIVVGLALRDEPADVPVIAQWPIYPAADPGKSYPSYKDFGEGYFLSHVGMAWFDGCYRPDKADWRYSPLLKSQVGMPPTLVQTASLDPIRDQGRAYAAACAEAGVPVVFREAEGNIHGYINLRKAIPSSADDIAAGVEALKMILKAVKA

SEQ ID NO: 535 - DNA, 1026 bp, Unknown
  Obtained from environmental sample
gtgaaacattatgtaattgcactgacaaccgccttcctgctctatacagccttgccggctacggctgcggatacgagccggagctatcccgttccgaacaccgtcagcccggaactgcaaacgctcatcggttccgctccgtttccatactggaacaggcacccggccaatgcggaagaatggaaggcctttgtcaaggaactctcggatgccgccgcgccgggaatacccgtgttgcgggaaaaaatgggcgtcacctccacacccggcgttatggccggggtaccggtcttcaccataaccccgcggaatctgcccgccgccaatgcggatcgcgtgctgctccattttcatggcgggggatatgtgctggggcctggagaaaccggaaccgacgaagccattctgatggcgggagtctccgggtaccgggtcatttccgtggattacagaatggcgccggatcatccttacccggcggccatagacgatgccgtcgcggtctacaaggaacttctcaaaaccgtgcctgccggaaagatcggcgtcttcggcacctccacaggcggaggcatgacgctcatcctggccctgcgcgcgaaagccgaagggttacctatgcccggcgctctcggcgcgggaacgccgtggactgatatgaccaaaaccggtgatacctacttcaccaacgagtatctcgataacgttttggtcagttacgacggatgggtcggtgatgcggccaaaatatacgccgccgggcatgacctgaaagaccccatgctttctccggtgtatggcgatgtttccggctttccacccacactgctgacatcgggcacccgcgacctttttctgagcaacacagtgcgcatgcaccagaagctacggcaagcgggagctacggcggacttgatcgtttttgaaggcatgtcccactgccattactactttcttcctgatgcgcctgaaacccgcttccacttcacggagctcggtaaattcttcggacgtcatttacagtaa

SEQ ID NO: 536 - protein, 341 aa, Unknown
  Obtained from environmental sample
  SIGNAL (1)...(22)
MKHYVIALTTAFLLYTALPATAADTSRSYPVPNTVSPELQTLIGSAPFPYWNRHPANAEEWKAFVKELSDAAAPGIPVLREKMGVTSTPGVMAGVPVFTITPRNLPAANADRVLLHFHGGGYVLGPGETGTDEAILMAGVSGYRVISVDYRMAPDHPYPAAIDDAVAVYKELLKTVPAGKIGVFGTSTGGGMTLILALRAKAEGLPMPGALGAGTPWTDMTKTGDTYFTNEYLDNVLVSYDGWVGDAAKIYAAGHDLKDPMLSPVYGDVSGFPPTLLTSGTRDLFLSNTVRMHQKLRQAGATADLIVFEGMSHCHYYFLPDAPETRFHFTELGKFFGRHLQ

SEQ ID NO: 537 - DNA, 912 bp, Unknown
  Obtained from environmental sample
atggcgtcggtggtcgaacaggcgaacagcgtggaggaccagcgggtcggctacgacggcttcggcgactcgatgccgcgtccgtatgcccgacccgtccgccagctgatcgacggtcccgtcgtgacgcacgtgatcgaccccgacctcgagggggaggtggcgagcgtcttctatctccacggcggcgggtacatgatcggttcgcttcggtcgcaccgtgcctttctggagctcctcagcgcgaagctgggcgtccgggtctacttcccggagtaccgcctggctcctgaacaccggtatccgagcgcagtcgacgacgcggtcggcgcctacgaggcggtgctgcggtcgggtgtcgcgcccaagaccgtggcggtggtcggcgactcggccgggggcggcctcgccttggccgccgtccttgccattcgggatcgttcgatcccgcttcccggagcggtcatcgccctttcgccgtgggccgacatggtgggcaccggggagtcccggaagagccaggagggcatcgatcccatgctggcccaagaggggctggacgagatggcggcggcgtacctgggcccggccgcagcgacgtcgccctatgcgtcgcccgcttacggcgacttcagcggttaccccccgcttctgctccaagtcggcgagtgcgagatcctgcgcgacgacgcactgatcgtggccgaacgggctaccgcggccgatgtgcgtgtccaggtcgaggtgtggcccgagatgacccacgtcttccagacgttcgcgccgctcctgccccccgggcacgaagccctcgaggccctggagcacatgggccggttcattgccgaggcgagcgggatcgcgtccgtctcggcgccgtcggtctcaaggtcgccggctgccggccggtga

SEQ ID NO: 538 - protein, 303 aa, Unknown
  Obtained from environmental sample
MASVVEQANSVEDQRVGYDGFGDSMPRPYARPVRQLIDGPVVTHVIDPDLEGEVASVFYLHGGGYMIGSLRSHRAFLELLSAKLGVRVYFPEYRLAPEHRYPSAVDDAVGAYEAVLRSGVAPKTVAVVGDSAGGGLALAAVLAIRDRSIPLPGAVIALSPWADMVGTGESRKSQEGIDPMLAQEGLDEMAAAYLGPAAATSPYASPAYGDFSGYPPLLLQVGECEILRDDALIVAERATAADVRVQVEVWPEMTHVFQTFAPLLPPGHEALEALEHMGRFIAEASGIASVSAPSVSRSPAAGR

SEQ ID NO: 539 - DNA, 975 bp, Unknown
  Obtained from environmental sample
atgcaggttcgtcttattggccgctggctggccttggccgccgcggtgatggttctggtgcccgccatggccgacgcgcgcgccggtgccggttcgagctcgggcagccgcggcagccggaccaaccaggcgccgcccccgacccagaccgcgccgaccgccaagccggtcgaacgcagcgtgacgccgcaggcgccggcgcagcagccgtcgatggcatcggccccggcggccaacccgcgacccggcttcttcgcccgcaacccgttcctctccggactgatgggcggcctggtcggcgccggcttgctgggcatgctgttcggcggcggcttcggcggcgcagccggcatgggcggcctgctcgtgcagctccttctgatcggcgggctggcctatctgggcgttcgcctgttccgcggctggagcgcgcgaaacgccgctgctgctggcccgtcgtcctatgcctacgccgcggctccgggcggcatgcccgagcagccggcgccacgcgcgaatggcgcgctgctcggcggcgctgctccacttttgatgggcaacgcgtccacgccgctcgccatcgccgagggcgactacaatgccttcgaggccctgttggccgacgtccagtccgcctacagcacgggcaacctcgcgaagatgcgcgagctcgcgacgcccgagatggtcggctatttctcggaagagctctcgggcaacgccagccgcggcgtcgagaacaaggtcgaggcggtcaagctcgagcagggcgacctgtcggaggcctggagcgaagccggcatcgactacgcgaccgtcgccatgcgcttcagcatgctcgacgtcacgcgccggcttgccgacggcacgatcgtcgagggcaacgaccacgtccgcagcgaagcgaccgagatctggaccttcctgcgcagccgcggcggcaagtggatcctgtcggccatccagcaggcgtag

SEQ ID NO: 540 - protein, 324 aa, Unknown
  Obtained from environmental sample
  SIGNAL (1)...(24)
MQVRLIGRWLALAAAVMVLVPAMADARAGAGSSSGSRGSRTNQAPPPTQTAPTAKPVERSVTPQAPAQQPSMASAPAANPRPGFFARNPFLSGLMGGLVGAGLLGMLFGGGFGGAAGMGGLLVQLLLIGGLAYLGVRLFRGWSARNAAAAGPSSYAYAAAPGGMPEQPAPRANGALLGGAAPLLMGNASTPLAIAEGDYNAFEALLADVQSAYSTGNLAKMRELATPEMVGYFSEELSGNASRGVENKVEAVKLEQGDLSEAWSEAGIDYATVAMRFSMLDVTRRLADGTIVEGNDHVRSEATEIWTFLRSRGGKWILSAIQQA

SEQ ID NO: 541 - DNA, 579 bp, Unknown
  Obtained from environmental sample
atgcttgtaaatgaaggatatgcagtctatacatttgactggccaggtcatggaaagagcccaggaaaaagaggtcatacaagcgttgaagaagcaatggaaataatagactttatcatagaggagataaacgataaaccttttctctttggccacagcctcggaggattaacagtgataagatatgcagaaacaaggccagaaaagattagaggagttattgcctcctccccagctctggctaagagcccaaaaacaccctcttttatggttgcacttgcaaaaattcttggagtcttgcttccaagcttaacactctccaatggaatagatcccaatcttctctcaagaaatccagatgctgtaaaaagatacatagaagatcccctggttcatgacagaatttctgccaaactgggaaggagcatattcaagaacatggatcttgctcacagagaagcccacaaaattaaagttccagttctactcttagttgggactggggatgttataactcctccagaaggagctagaaagttatacggggaaatcaaagtggaagataaggaaattgtatag

SEQ ID NO: 542 - protein, 192 aa, Unknown
  Obtained from environmental sample
  DOMAIN (7)...(192): alpha/beta hydrolase fold
MLVNEGYAVYTFDWPGHGKSPGKRGHTSVEEAMEIIDFIIEEINDKPFLFGHSLGGLTVIRYAETRPEKIRGVIASSPALAKSPKTPSFMVALAKILGVLLPSLTLSNGIDPNLLSRNPDAVKRYIEDPLVHDRISAKLGRSIFKNMDLAHREAHKIKVPVLLLVGTGDVITPPEGARKLYGEIKVEDKEIV

SEQ ID NO: 543 - DNA, 837 bp, Archaea
atgaagactgtggaagagtatgcgctacttgaaacaggcgtaagagtgttttatcggtgtgtaatcccggagaaagcttttaacactttgataataggttcacacggattgggggcgcacagtggaatctacattagtgttgctgaagaatttgctaggcacggatttggattctgcatgcacgatcaaaggggacatgggagaacggcaagcgatagagaaagagggtatgtggagggctttcacaacttcatagaggatatgaaggccttctccgattatgccaagtggcgcgtgggaggtgacgaaataatattgctaggacacagtatgggcgggctgatagcgctcttaacagttgcaacttataaagaaatcgccaagggagttatcgcgctagccccggccctccaaatccccttaaccccggctagaagacttgttctaagcctcgcgtcaaggcttgccccgcattctaagatcaccttacaaaggagattgccgcagaaaccagagggttttcaaagagcaaaagatatagaatacagtctgagtgaaatatcagtcaagctcgtggacgaaatgattaaagcatcatctatgttctggaccatagcaggggaaattaatactcccgtcctgcttattcatggggaaaaagacaatgtcatacctccggaggcgagcaaaaaagcctaccaattaataccttcattccctaaagagttgaaaatataccccgatcttggacacaacttgttttttgaaccaggcgcggtgaaaatcgtcacagacattgtagagtgggttaagaatctacccagggaaaatccttaa

SEQ ID NO: 544 - protein, 278 aa, Archaea
  DOMAIN (56)...(268): alpha/beta hydrolase fold
MKTVEEYALLETGVRVFYRCVIPEKAFNTLIIGSHGLGAHSGIYISVAEEFARHGFGFCMHDQRGHGRTASDRERGYVEGFHNFIEDMKAFSDYAKWRVGGDEIILLGHSMGGLIALLTVATYKEIAKGVIALAPALQIPLTPARRLVLSLASRLAPHSKITLQRRLPQKPEGFQRAKDIEYSLSEISVKLVDEMIKASSMFWTIAGEINTPVLLIHGEKDNVIPPEASKKAYQLIPSFPKELKIYPDLGHNLFFEPGAVKIVTDIVEWVKNLPRENP

SEQ ID NO: 545 - DNA, 942 bp, Unknown
  Obtained from environmental sample
atgcgcctccgagcgctgcaggtcgccttctacctggccttcctgctcgcgctgccgagcggccccgccgcggcgcagagccggggcccgctcgagctggcgagggcgccggtgcccgccggcgcgctccgcatcgcctacgggagtgatccgctgcagttcggggagctgcgcctgccggcgacggaggggccgcatccggtggcgatcgtggtgcacggcggctgctgggtcgcgaagctcggaaacctggacgagcgcgccgtcgcgctggacaacatgcgcccgctggccgcggcgctgacggaggcggggatcgcgacctggaacctcgagtaccgccgcctcggccatgtgggcggcggctggccgggtaccttcctcgacgtagccaacgcggcggatcatctgcgcaccctggcccgggagcatccgctcgacctggcgcgcgtgatcgccatcgggcactcggcgggcgggcacctcgccgtgtggctggcggcgcgcggcagggtgccggcgaccagcgagctgcatgcagcggatccgctgccgctgatcggggcggtgaacctcgatgggcccgcggacctgcagagcatgcttccgctgcaggagcgcatctgcggccggccggtcatcaccgagctgatggagggcacgcccgccgagcggccggagcgctaccgcgccacctcgcccctcgacctgctccccctgggagttcgccagaaagtacacgcgggccgcatgttcgccgagcaggccgaggcgtaccaggccctcacgcagcaggcgggcgatccgatcacagcgacgatcatcgccgacgccggccatttcgtgttcatcgatccgcagtcggctgcctggccgcgcgtgctggagagcgttcgccgcctgctgctgatcccggactccgcggcgccggaggagtcgtga

SEQ ID NO: 546 - protein, 313 aa, Unknown
  Obtained from environmental sample
  SIGNAL (1)...(25)
MRLRALQVAFYLAFLLALPSGPAAAQSRGPLELARAPVPAGALRIAYGSDPLQFGELRLPATEGPHPVAIVVHGGCWVAKLGNLDERAVALDNMRPLAAALTEAGIATWNLEYRRLGHVGGGWPGTFLDVANAADHLRTLAREHPLDLARVIAIGHSAGGHLAVWLAARGRVPATSELHAADPLPLIGAVNLDGPADLQSMLPLQERICGRPVITELMEGTPAERPERYRATSPLDLLPLGVRQKVHAGRMFAEQAEAYQALTQQAGDPITATIIADAGHFVFIDPQSAAWPRVLESVRRLLLIPDSAAPEES

SEQ ID NO: 547 - DNA, 1194 bp, Unknown
  Obtained from environmental sample
atgaacaaacgaagtttgcgcaagtgtttgagcgctgtcggtgtcgttgcgatcctgttctcggtgcaacaggtgctagcctatgacgagatcgtgcagaagcaggcctttgagcttgcctcctacacaaccaccggcggggagacgatcaaggacgtccgcatcggctgggaggcctacgggacgttgaacgaggccaaggacaacgtcatcctgattacccacttctattccggcaacagccatgccgccggccgctacaccgccgagggtcctgccggctattggaacgccatcatcggttcaggcaagccgatcgataccgacaaatactacgtcgtgtcgtccgacaccctggtgaatctcggcgccaatgatcccaatgtcatcaccaccggtccggcctccatcaatcccgacaccggcaagccctacggcatgagctttccgatcgtgacgatgcgcgatttcgtcgaggtccagagggaattgcttgatagcctcggcatcgagaggctgcatgcggtgatcggtgcctcaatgggcgccctgcaggcctatgagtgggccgcggcctatcccgagcgggtcgagcgcctcattccggtgatcggcagcggctgggccgacggcgacctgatcggctggctcaacatctggtcggcgccgatcaagctcgaccccaactggaatggcggcgactactatgacggcgagccgccgctgcaggggcttgccgagtcgctgaagatcgtgacgttgcaggccaaccactggaaatggtccaacagcgtgttcggccgcgcctgggccaaggacggtgccgatccggcggcaagcttcgacaatctgttcaggatcgaggcggtgcttgacggggccggccaggcccgcgccaagaccagcgatgccaatcatttcctctacctcgccaaggccaatcagctgttctatgccggccacggcgaaaccctctatgaaggcctgcgggcgatcacggcgccgacgctgatcatccatagcgatgacgacctgctgttcccgcccgccgcgatccgcgaaaccgccgccatgatcagatcgggcggcgcgccggtcgaggtggtcgggctgcacggcgggcgcggtcatctggatggagtcctgtcaatcagccaggccggcgcgcagatcggggcattcctcgcgaggtga

SEQ ID NO: 548 - protein, 397 aa, Unknown
  Obtained from environmental sample
  SIGNAL (1)...(27)
  DOMAIN (68)...(393): alpha/beta hydrolase fold
MNKRSLRKCLSAVGVVAILFSVQQVLAYDEIVQKQAFELASYTTTGGETIKDVRIGWEAYGTLNEAKDNVILITHFYSGNSHAAGRYTAEGPAGYWNAIIGSGKPIDTDKYYVVSSDTLVNLGANDPNVITTGPASINPDTGKPYGMSFPIVTMRDFVEVQRELLDSLGIERLHAVIGASMGALQAYEWAAAYPERVERLIPVIGSGWADGDLIGWLNIWSAPIKLDPNWNGGDYYDGEPPLQGLAESLKIVTLQANHWKWSNSVFGRAWAKDGADPAASFDNLFRIEAVLDGAGQARAKTSDANHFLYLAKANQLFYAGHGETLYEGLRAITAPTLIIHSDDDLLFPPAAIRETAAMIRSGGAPVEVVGLHGGRGHLDGVLSISQAGAQIGAFLAR

SEQ ID NO: 549 - DNA, 954 bp, Unknown
  Obtained from environmental sample
atgttctatcgaatttctctgttgattaccggcctggttctggtgctgtttttctgcctggcgctgtggagccggcttggtattcaggccttgcagcgcgactacccgccgacgggcgactttatcgatgtcgacggctaccgcctgcattatcagttgcgcggcaatgggccgcccatcctgttgatccatggcgccaattccaatctgcgggacttcagttcaagcctgatgccgcggctggcgcaacaatatacggtgctggccatcgaccggccaggctatggttacagtagcaggccacccgacggcgactggctggaccccgccgctcaggcgcggctgctgttactggcggcgcatcagctcggcctggaacgcccgctgctggtcgggcattcctgggcgggcgccgtggtcatgaccgcgctggtgcgcatgccggagcaagtatcaggtggggtactgctggcgggtgccagcgggcactggagcgggtccacgggtgcaatctacaccctggccaaagtgccgtttgtgcgtgagttgtttgcccacaccctggtctatcccgccggaagggtgttcatcgacagggctgttgccaaggtgatggcgccgaatcccgtacccgaaaactatcgccagcgcattgccgccgatctggcgctgcggccgggaaccttccttcacaatgccgcggatatgaatcgactcagcgagttcctgcagggcgaaagccgttactacgacaggatcgaacagcctctgttgatcattcacggcgaggccgacgaactggtaccgttctggaatcacggtcagcgcctgttgtccgtggtcgccgacactgaattgatgctgctgcccgatgtcggccacgcaccccaccacgtgcaagccgatgccattgcccgccggattgccgaattccgggctcgcctggggcggtaa

SEQ ID NO: 550 - protein, 317 aa, Unknown
  Obtained from environmental sample
  DOMAIN (85)...(310): alpha/beta hydrolase fold
MFYRISLLITGLVLVLFFCLALWSRLGIQALQRDYPPTGDFIDVDGYRLHYQLRGNGPPILLIHGANSNLRDFSSSLMPRLAQQYTVLAIDRPGYGYSSRPPDGDWLDPAAQARLLLLAAHQLGLERPLLVGHSWAGAVVMTALVRMPEQVSGGVLLAGASGHWSGSTGAIYTLAKVPFVRELFAHTLVYPAGRVFIDRAVAKVMAPNPVPENYRQRIAADLALRPGTFLHNAADMNRLSEFLQGESRYYDRIEQPLLIIHGEADELVPFWNHGQRLLSVVADTELMLLPDVGHAPHHVQADAIARRIAEFRARLGR

SEQ ID NO: 551 - DNA, 1851 bp, Bacteria
atgggtgtttttcagtacaaagactttgatgacactacttccaaagagttattttccgacgcaaaaattatctccggatatgcttaccataatctgggcagcggatttgctgaggggtattacaattatggttatggtttagggatgccattaacattggtgaccgcacttctcggcagcacgacatcgcagggtatcacacctaaattgccttggaatccggacgcagaaaaacaggcacgagataaactcaatgaatcgggatggtttactatcagtgctgatgagttaggctatcagggtaaaactgatgcccgcggtactttttttggcgaaaaatcaagtcattccactgctcaggcagaggtaatgggaaaatatgatgctgatggtaatttgatttctattggcattgcgtttcgtggtacgagtggtcctcgagagtcagttattaccgatacattcggcgacattatgaataatgtgctggtagctttgggtaagaaagactattcgaatgactacacgccaaacgcttttggtcggctgctggaccatgtggctaattatgccaaagctcacggtttgacaggcaatgacgttgtggtcagcggccatagtttgggtgggttagctgtgaatagtatggcggagtctagcgatacgaaatgggggggattctactctcagtcgaattatatctctttcgcttcgccatcacagtatgaaataggtaacaaggtgctgaatgtaggatatgaaaatgatcccgtattccgtgtattaaacggcaccaccgttgatgcgttctccccaggtgttcacgatgtaccaagggattcggctacaaataatattgttaactttaacgatcactatgcatcaaattggtggaatatattgcccttctctattgctaatctgtcaacctgggtttcgcatgtgacgccgttttatcagagcggcatgcaacgtattatggagtcaacgttctacaatctaactcataaagactctactattgttgtcagcaatctttccaatgtcacccgtgaaaatacttgggtacaagatttgaaccggaatgctgagaaacacacaggtagtacttttgttattggtaccgacggcaacgacctcattaaaggtggtagaggaaacgattatctggaagggcgcgatggcaatgatatcttccgtgatgacgggggatttaacatgattgccggcggaaaaggtcataatacctttgacttacagaagtcactaaaaaatgcagaaatagcctatgacaaggcagggacattgtatgtgcgtgatgcacaaggtggtatcaccgttgctacggatatttcgacgataagaagtaaggaaagtacctggctatttctgactaaacaggtggattctcaagttaaagccgatggtttgtattccagccgtggagtaacgaaatacgctaattcagtaaccggcaacgatgggaatgatacactgacttctaaaacctccggtagctggctgttcggtctggatggtgatgatacgttgatcggcttcggcaacaataatgttttcgtcggtggtgaaggcaacgatgtcatgaaaagtcagggtaataacaatactttcctgttcaacggcgagtttgggcaagatatcatctatggctacaataagaccgataaattggtgttcttgggtaccgaaggcagcagtgataaaagtaattatctggatcatgcttctatggtggacaataatttggtgtttactttcggccaaaactcagtcactttgattggcgtcagcatggacagcttattggtagataatataatactggcgtaa

SEQ ID NO: 552 - protein, 616 aa, Bacteria
  DOMAIN (133)...(266): Lipase (class 3)
MGVFQYKDFDDTTSKELFSDAKIISGYAYHNLGSGFAEGYYNYGYGLGMPLTLVTALLGSTTSQGITPKLPWNPDAEKQARDKLNESGWFTISADELGYQGKTDARGTFFGEKSSHSTAQAEVMGKYDADGNLISIGIAFRGTSGPRESVITDTFGDIMNNVLVALGKKDYSNDYTPNAFGRLLDHVANYAKAHGLTGNDVVVSGHSLGGLAVNSMAESSDTKWGGFYSQSNYISFASPSQYEIGNKVLNVGYENDPVFRVLNGTTVDAFSPGVHDVPRDSATNNIVNFNDHYASNWWNILPFSIANLSTWVSHVTPFYQSGMQRIMESTFYNLTHKDSTIVVSNLSNVTRENTWVQDLNRNAEKHTGSTFVIGTDGNDLIKGGRGNDYLEGRDGNDIFRDDGGFNMIAGGKGHNTFDLQKSLKNAEIAYDKAGTLYVRDAQGGITVATDISTIRSKESTWLFLTKQVDSQVKADGLYSSRGVTKYANSVTGNDGNDTLTSKTSGSWLFGLDGDDTLIGFGNNNVFVGGEGNDVMKSQGNNNTFLFNGEFGQDIIYGYNKTDKLVFLGTEGSSDKSNYLDHASMVDNNLVFTFGQNSVTLIGVSMDSLLVDNIILA

SEQ ID NO: 553 - DNA, 1278 bp, Unknown
  Obtained from environmental sample
atggtatatttattcatcagcgtgtttttgcttttactcgccctatgcgcgcttgtgcgcacgccaaaaatcaatgcggtgagaactctatggtttatcgccggtttgttgccgagcgagctgccttggttttttggtgggctgcaactggtgcttatcgcggttttgctgatactcggcgatctttcgtcgtcaacgcacttgaccgctttgatcctgtcagtaggtaccttgaccttatggtacggcttgcacagaaaaacctatttaagcggcactaaactggagcaggctttgtgtgctggtctcggtaaagattatcaacgaaatgtgtcacccgactcggttatccaggccccgtcagtgatcggcaagaaaagttggttaaaacctttttcttttaagcgcgccggggttgagcgagtcaacgatgtggcttatggctcagacccgcgccagaaaatggacatctatcaaatggcgcctccgaaagaagagagtgttgaagattcccataagcgtccggtgctggtctacgtgcacggcggcggctgggttatgggcagcaaacatcagcaaggccagcccctgttaaactatttggctcaaaatggttggttgtgtgtggatatcaattatcggttgtcgcccaaaaaccgttatccggattcccttgttgatgttaaaacagcgatcgtctggttaaaaaataatattcacaattatggcggcgacccaaattttatcgccctggccggtggttccgccggcgggcatctatgcgcattggcagcgcttacgcccaatgtgccgcagtttcaaccgggctttgaacagtccgatacttcggtccaggcagctgtgccgatctatggcgtttacgattttaccaattccaaaaacacttggtccggtaaaaccttgcgccagtttgtgcagcggttggtgatgcctgctgacaaagaggatgaccccgcgttttggcgcgcggcatcgcccaaatttcaagtgcataataacgcgtcgccgatgatgctaatccacggaaccacagacgccttggtttttgttgaagaggcgcgggatttcgcctttaccctagccgcccatactcacgcaccctgggtctacgccgaactgcccggcgctcagcacggctttgatctttttcattccgtgcgcaccgagtacaccattgaggctatcggaaaatttttacgctattgccatcaagcctcacgcacgcccacaccgaaaggcaggggcgtttttgagtga

SEQ ID NO: 554 - protein, 425 aa, Unknown
  Obtained from environmental sample
MVYLFISVFLLLLALCALVRTPKINAVRTLWFIAGLLPSELPWFFGGLQLVLIAVLLILGDLSSSTHLTALILSVGTLTLWYGLHRKTYLSGTKLEQALCAGLGKDYQRNVSPDSVIQAPSVIGKKSWLKPFSFKRAGVERVNDVAYGSDPRQKMDIYQMAPPKEESVEDSHKRPVLVYVHGGGWVMGSKHQQGQPLLNYLAQNGWLCVDINYRLSPKNRYPDSLVDVKTAIVWLKNNIHNYGGDPNFIALAGGSAGGHLCALAALTPNVPQFQPGFEQSDTSVQAAVPIYGVYDFTNSKNTWSGKTLRQFVQRLVMPADKEDDPAFWRAASPKFQVHNNASPMMLIHGTTDALVFVEEARDFAFTLAAHTHAPWVYAELPGAQHGFDLFHSVRTEYTIEAIGKFLRYCHQASRTPTPKGRGVFE

SEQ ID NO: 555 - DNA, 957 bp, Unknown
  Obtained from environmental sample
atgaggatccgtgcgctgaccacctgcttcgccctgctcgccgcagggctgctcctgtcgccacccgcgatggcggagggtgaccccgagtacagcgtccccctggagctgctgcgcggctcggtggactgcaatgccgagttcgtccatctcgaccgggagccggtcctgctcgtgcacgggacgtccggcacgcccgaggaagcctgggcctggaactacatcgagaacctcccccgccaggggttcgacgtgtgctgggtccgcctccccaaccgggcgctcagcgaccagcaggagtcggcagagtacgtggtgtacgcgctgcgactcatgcacgagcgggcggagggacgcaagatcgacgtgataggccacagccagggtgggctgctgccccgctgggcgctgcgttggtggccgagcctgcgcgacatcgtggacgacttcgtcccgctcgccgcgcccgcccacggcgccagcggcgcagagatgttctgtccgacgagctgcgcgcccgcggtccagcagatgaagcccgactcccgctacctcgccgccctcaactcagtggacgaaacccccggcgacgtggactacacgagcatctacagcatgaccgacgagctcgtgcagccctacaccagccctccgctggaaggcgggaccaacatcgcgatccaggacgtctgtcccggccgggtcgtgcatcactacgggatcgtctacgacgcggtcgcctacgccctggtggtcgatgcgctcgtcaacccgggcccggccgacccggcccggctccccgccgacatctgcctacagacgtggatgccgggtgtgaacgagatcgacgtcgtggccgggaacatgatggcttacgggaacgcctacctggccttcggtgcctacccacccagcgattccgagcccgagccgaagccctacgtggacgaggactga

SEQ ID NO: 556 - protein, 318 aa, Unknown
  Obtained from environmental sample
  SIGNAL (1)...(25)
  DOMAIN (53)...(257): Lipase (class 2)
MRIRALTTCFALLAAGLLLSPPAMAEGDPEYSVPLELLRGSVDCNAEFVHLDREPVLLVHGTSGTPEEAWAWNYIENLPRQGFDVCWVRLPNRALSDQQESAEYVVYALRLMHERAEGRKIDVIGHSQGGLLPRWALRWWPSLRDIVDDFVPLAAPAHGASGAEMFCPTSCAPAVQQMKPDSRYLAALNSVDETPGDVDYTSIYSMTDELVQPYTSPPLEGGTNIAIQDVCPGRVVHHYGIVYDAVAYALVVDALVNPGPADPARLPADICLQTWMPGVNEIDVVAGNMMAYGNAYLAFGAYPPSDSEPEPKPYVDED

SEQ ID NO: 557 - DNA, 1689 bp, Unknown
  Obtained from environmental sample
atgggattgtttgattacaaaaatgccgacggcaaagcgttgtacagcgatgcgatcgcgctgacgctgtattcctacacgccgaccgggcagcctttgcccggtaccggttggtcgccactgggtgcctcggccctgggttatcaaggcaagaccgacgcgaaagggactttcttcggcgagaaggacggcttcaccagcgccgaggcggaagtgctgggcaaatacgacgccgccggcaagctgatcggcatcggcgtggcctttcgcggcactggcgggctgagctacagcgacaccttcggcgacatgaaaaacaatctgctggccgccatcgggccggtggattacgccaagaattacgcgaaaaacgccttcgacaacctgctcaaatccgtcgccgcgtttgccacggctcacggcattgccgccaaggacgtgctgattagcggccacagcctcggcgggcttggggtcaacagcgtggcggagctgagcgcgagcgactggggtggtttcttcaaggacgccaactatatttcgttcgcctctccgacccagagcagcaccggtaccaacgtgctgaacattggctacgagaacgatccggtattccgtgtgctcgacggcaccacgttcagcacggcgtcgatgggcaaacacgacaagccgcacgactcgaccaccgacaacatcgtcaacttcaacgacaactacgcgtccaccgcgcagaacctggtgccgttcagcatcgtcaacccgctgaactggtcggcccacagttcgctgggctatgccgatggtctgaaccgggtgatcgactcgaagttctacaacctcaccagccaggactcgaccatcatcgtgtccaatctggaggcctcgtcccggggcaagacctgggtcgaggatctgggccgcagcggcgagccgcacaccggcagcaccttcatcatcggcaccgacagcaacgactggctcaagggcggggcgggcaacgacttcctcgaaggccgtgccggcgatgacctgttccgcgatgacgggggcttcaacattttgttgggtggtcagggccacaacaccttcgacctgcaaaaaccgttgcagaacttcagcttcgccaacgacggcgacggcacgctctacgtgcgcgacgcctacggcggcatcagcatgacccgtgatatcggcgcgatcgtgagcaaagagtccggttcgatgtggagcagcaaggaaatcacctggaccgtcaccggcaaaggcctggccaacggcgccgaactgacccagtacaaccattcgctcaacggcggcgcactcggcgacacgctgaaagccaccgctgacggcgactggctgttcggcctgggcggcgacgatcacctgttcagcgacaaggcccacgtaaccttcgtcggcggcgccggcaatgacgtgatgagtgcggtgggtggcaataacaccttcctgttcagcggcgcgttcggcttcgactcgatccatggctaccagggcagcgacaaactggtgttcatgggcgtgcagggcgcggggcagggctacgactacaagcaacatgcttcgcagtccggcgccgataccgtgctgaagattggcgactatgccgtgaccctgatcggggtgggtgtggctaacctgtcggactcgagtttcgtgttcgcctga

SEQ ID NO: 558 - protein, 562 aa, Unknown
  Obtained from environmental sample
  DOMAIN (82)...(212): Lipase (class 3)
  DOMAIN (328)...(345): Hemolysin-type calcium-binding repeat (2 copies)
MGLFDYKNADGKALYSDAIALTLYSYTPTGQPLPGTGWSPLGASALGYQGKTDAKGTFFGEKDGFTSAEAEVLGKYDAAGKLIGIGVAFRGTGGLSYSDTFGDMKNNLLAAIGPVDYAKNYAKNAFDNLLKSVAAFATAHGIAAKDVLISGHSLGGLGVNSVAELSASDWGGFFKDANYISFASPTQSSTGTNVLNIGYENDPVFRVLDGTTFSTASMGKHDKPHDSTTDNIVNFNDNYASTAQNLVPFSIVNPLNWSAHSSLGYADGLNRVIDSKFYNLTSQDSTIIVSNLEASSRGKTWVEDLGRSGEPHTGSTFIIGTDSNDWLKGGAGNDFLEGRAGDDLFRDDGGFNILLGGQGHNTFDLQKPLQNFSFANDGDGTLYVRDAYGGISMTRDIGAIVSKESGSMWSSKEITWTVTGKGLANGAELTQYNHSLNGGALGDTLKATADGDWLFGLGGDDHLFSDKAHVTFVGGAGNDVMSAVGGNNTFLFSGAFGFDSIHGYQGSDKLVFMGVQGAGQGYDYKQHASQSGADTVLKIGDYAVTLIGVGVANLSDSSFVFA

SEQ ID NO: 559 - DNA, 870 bp, Unknown
  Obtained from environmental sample
atgtcaaagaaactcgtaatatcggtagcgggcggcggagcactcggaatcggaccactcgcattcctgtgcaagattgaacagatgctgggaaagaagataccccaggttgcgcaggcatacgccggcacttcaaccggagcaataattgcggcaggactggccgaaggctactccgcgcatgaactgttcgacctatacaaatcaaatctcagcaagatattcaccaaatacagctggtacaaacgcctgcagccaacgtgtcctacatatgacaacagtaacctaaagaaattactgaaggacaaattcaagggcaaggtcggcgactggaaaactcccgtatacatcccggcaacacacatgaacggccaatccgtagaaaaggtgtgggacttgggtgacaagaatgttgacaagtggtttgccattctgacaagtaccgcggcaccaacctatttcgactgcatatacgacgacgagaagaactgctacatcgatggtggcatgtggtgcaacgcaccaatcgatgtgcttaatgcaggcctgatcaagtccggctggtccaactacaaggtcctggacctggagaccggcatggacacaccgaatacggaaagcggaaacaagacacttctcggatggggggaatacatcataagcaactgggtagcccgttccagcaagtccggcgaatacgaggtaaaggccataatcggggaagacaatgtatgtgttgcccgtccatacgtaagcaagaaaccgaagatggatgacgtggacagcaagacgctggatgaagtcgtggatatctgggaaaactacttctacgccaagcagaaagacatcgcatcgtggctgaaaatctag

SEQ ID NO: 560 - protein, 289 aa, Unknown
  Obtained from environmental sample
  DOMAIN (7)...(180): Patatin-like phospholipase
MSKKLVISVAGGGALGIGPLAFLCKIEQMLGKKIPQVAQAYAGTSTGAIIAAGLAEGYSAHELFDLYKSNLSKIFTKYSWYKRLQPTCPTYDNSNLKKLLKDKFKGKVGDWKTPVYIPATHMNGQSVEKVWDLGDKNVDKWFAILTSTAAPTYFDCIYDDEKNCYIDGGMWCNAPIDVLNAGLIKSGWSNYKVLDLETGMDTPNTESGNKTLLGWGEYIISNWVARSSKSGEYEVKAIIGEDNVCVARPYVSKKPKMDDVDSKTLDEVVDIWENYFYAKQKDIASWLKI

SEQ ID NO: 561 - DNA, 468 bp, Unknown
  Obtained from environmental sample
atgaagaaactactgctcaccgtctgcctcgcggccttcgcgtcaatcggggcgagagccgaacttgcgagcgtcagcctcgaagccggcgacaacgccgttccggcaccctgccgagccgtgatggtacacgccatttcgacgaacgcgtccggaaccgtcacgctgaagaaggtcagctcgttttccctcgcgtggatcgactggcagaccgtcaccaacatcacctacggaacggcgtggtcgaacttgacgcacaccgtcacgaacgacgttgtgacggcatggcgcacaaacacggtcgatggagcgaccgtcacaaacttcgtcgcccgcgcggtaaacgagatgccgtccgtctttccgtggcccgaccttctgatcctcacgaacaaggttgcgtcgagcgtcgtctatacgaacatcccgtacaggatcgaggcgtcgcggcgcgtcgagacggtgggg

SEQ ID NO: 562 - protein, 156 aa, Unknown
  Obtained from environmental sample
MKKLLLTVCLAAFASIGARAELASVSLEAGDNAVPAPCRAVMVHAISTNASGTVTLKKVSSFSLAWIDWQTVTNITYGTAWSNLTHTVTNDVVTAWRTNTVDGATVTNFVARAVNEMPSVFPWPDLLILTNKVASSVVYTNIPYRIEASRRVETVG

SEQ ID NO: 563 - DNA, 1854 bp, Unknown; identical to SEQ ID NO: 87
  Obtained from environmental sample

SEQ ID NO: 564 - protein, 617 aa, Unknown; identical to SEQ ID NO: 88
  Obtained from environmental sample
  DOMAIN (133)...(265): Lipase (class 3)
  DOMAIN (381)...(398): Hemolysin-type calcium-binding repeat (2 copies)

SEQ ID NO: 565 - DNA, 969 bp, Unknown
  Obtained from environmental sample
atgagctggatgcaatcggccgctagcatccttgccctggcgctggccctactggccggcggggtgtggctcgtggactggcgcgccgaccggcgcgaggcggaagcgctcgcgcagtggccgccggagggcatttttgtccaggttgaggaccgccgagtccacgccgtcacgcgggggcaaggccccgacctcgtcctgatccacggcgcctcgggcaatgcgcgggatatgaccttccgctttatgggcctgctaacggaccgctaccgtgtcaccgcgttcgaccgtccgggcctgggctacaccgaccccgcgccggccgattggggcgagagcccgaaggagcaggccgccttcctacaggccgcagcgcgggagctgcatatcgagagccccatcgtcctgggccactccttcggcggggctgtggcgctggcctggggattgagcgacccggaggggaccgccgccgtcgtggacgtttccggtgtggcgatgccctggcccggccgcctgggctggctctaccgcatcaatggcccgtggctcggtacggcccttgtgccgcctctcgttgctgcctttgcgccccaaccgctcctagaccgggcgctcgcggcgacgttcgcgcccgatcccgtccccgaaggctatgccgagcacttcggagccagcctctcgatccgacgcgcctcgtttcggaccaacgcccgtcaggtgaacgcgctgcgggcctcggtcatggagatgtcccgggactattcaaccttctccgtgccccttgaaatcgtccacggcgaagccgacaccattgtccccctcgaggtccattcctgccctctgtcgcgaatcattcctggcgcgaaccttacggtgctgcccggcgtcggccatatgccgcaccagacgcaccccgaggcggtggtcgccgctgtcgatcgggcgcgagcccgcgctgggctctga

SEQ ID NO: 566 - protein, 322 aa, Unknown
  Obtained from environmental sample
  SIGNAL (1)...(24)
  DOMAIN (90)...(315): alpha/beta hydrolase fold
MSWMQSAASILALALALLAGGVWLVDWRADRREAEALAQWPPEGIFVQVEDRRVHAVTRGQGPDLVLIHGASGNARDMTFRFMGLLTDRYRVTAFDRPGLGYTDPAPADWGESPKEQAAFLQAAARELHIESPIVLGHSFGGAVALAWGLSDPEGTAAVVDVSGVAMPWPGRLGWLYRINGPWLGTALVPPLVAAFAPQPLLDRALAATFAPDPVPEGYAEHFGASLSIRRASFRTNARQVNALRASVMEMSRDYSTFSVPLEIVHGEADTIVPLEVHSCPLSRIIPGANLTVLPGVGHMPHQTHPEAVVAAVDRARARAGL

SEQ ID NO: 567 - DNA, 951 bp, Unknown
  Obtained from environmental sample
atgcgtcgcatcttgatcgtgattgccatcgtcgtcgccggcttgctcgccggcctgaccgcctttgattacctcgcgcccgagaaagctgccgaaatcggcgtcggcctggagcgcgcacgcaacgggctggccgaaaagcagatcaccgtgaacgggctgaccatcgcctatctggatggcggcccggccaccggcgagccactggtcctgattcacggtttcggcgcggacaaggacaacttcacgcgcgtatcgggttacctgacgccgcagtaccgcgtgatcattcccgatctgccgggcttcggcgagagcagcaggcccgcggctgccgactacaccgtcggcgctcaggccgatcgcgtgcaagccttcgcgcaggcgctcggcatcacgcgtgcgcatttcggcggcagctccatgggtggtgcgatcatcaccgcccacgcactgaagtaccccgacgcaaccgccagcctgtggctgctcggaccgggcgggctgtccaaggccttcgactccgagctgggcaagactatccaggaaaccggcaagaacccgctgctggcgcagacaccggaggagttcccggcgatcatgcagttcgtgatgtccaagccgccgttcttcccctactcggttaaacacgtgctgggtaaacgggcggccgcggattatccattgcacggccgcatcttcgtccagatcaacgatccgcagcaggcctacccaagcttcgacggcctgatcaaggacatccaggcgccggccctggtcgtctggggcaacgaggaccgcgcgctcaaccacgaggcggcgcggatttacaaagccgagatgccgagggccgagatcatcatcatggatggcatcggccacctgcccatgatcgaggccgccaggcagtcggccaaggactatctggccttccgcggccgtatccagtaa

SEQ ID NO: 568 - protein, 316 aa, Unknown
  Obtained from environmental sample
  DOMAIN (93)...(310): alpha/beta hydrolase fold
MRRILIVIAIVVAGLLAGLTAFDYLAPEKAAEIGVGLERARNGLAEKQITVNGLTIAYLDGGPATGEPLVLIHGFGADKDNFTRVSGYLTPQYRVIIPDLPGFGESSRPAAADYTVGAQADRVQAFAQALGITRAHFGGSSMGGAIITAHALKYPDATASLWLLGPGGLSKAFDSELGKTIQETGKNPLLAQTPEEFPAIMQFVMSKPPFFPYSVKHVLGKRAAADYPLHGRIFVQINDPQQAYPSFDGLIKDIQAPALVVWGNEDRALNHEAARIYKAEMPRAEIIIMDGIGHLPMIEAARQSAKDYLAFRGRIQ

SEQ ID NO: 569 - DNA, 972 bp, Unknown
  Obtained from environmental sample
atgcaccaccgccatctcagcccactgatgcgcatccgagcgctacaggccaccttctacctggccttcctgctcgcgctgccgagcggccccgccgcggcgcagagccgcggcccgctcgagctggcgaccgcgccggtccccgccgccgcgctccgcatcgcctacgggagtgatccgctgcagttcggggagctgcgcctgccggcgacggcggggccgcatccggtggcgatcgtggtgcacggcggctgctgggtcgcgaagctggggcagctggacgagcgcgccgtcgccctggacaacatgcgcccgctggccgcggcgctgacggaggcgggcatcgccacctggaacatcgagtaccgccgcctcggccatgagggcggcggctggccgggcaccttcctcgacgtcgcaaacgcggccgatcatctgcgcaccctcgcgcgtgagcatcctctcgacctggcgcgcgtcatcgccatcggacactcggcaggtgggcacctcgccatctggctggcggcgcgcggcagggtgccggcgaccagcgagctgcatgcggcggatccgctgccgctgatcggggccgtgaacctcgatgggcccgcggacctgcagagcatggtgccgctgcaggagcgcatctgcggccggccggtcatcaccgagctgatggacggcacgcccgccgagcggccggagcgctaccgcgccacctcgcccatcgacctgctgcccctgggagttcgccagaaggtacacgcgggccgcatgttcgcggagcaggccgaggcgtaccaggccctcgcgcagcaggcgggcgatccgatcgcagcgaccatcatcgccgatgccggccatttcgtgttcatcgatccgcagtcggctgcctggccgcgagtgctccggagcattcgccgcttgctgctgatcccggactccgcgtcgccggaggaggagtcatga

SEQ ID NO: 570 - protein, 323 aa, Unknown
  Obtained from environmental sample
  SIGNAL (1)...(34)
MHHRHLSPLMRIRALQATFYLAFLLALPSGPAAAQSRGPLELATAPVPAAALRIAYGSDPLQFGELRLPATAGPHPVAIVVHGGCWVAKLGQLDERAVALDNMRPLAAALTEAGIATWNIEYRRLGHEGGGWPGTFLDVANAADHLRTLAREHPLDLARVIAIGHSAGGHLAIWLAARGRVPATSELHAADPLPLIGAVNLDGPADLQSMVPLQERICGRPVITELMDGTPAERPERYRATSPIDLLPLGVRQKVHAGRMFAEQAEAYQALAQQAGDPIAATIIADAGHFVFIDPQSAAWPRVLRSIRRLLLIPDSASPEEES

SEQ ID NO: 571 - DNA, 1059 bp, Unknown
  Obtained from environmental sample
atgtccgattcccggggcgcgaccgtgattccgggccacgggacggtgtacttcggtccctatcgtgcctcgagcggttggggcacgctcgaagcggagaagggcgtgctgatcgcgagtgacggcggttcgcgccgtgtgtcggcgcccgtgcggcgcgatgacggtacgtttgctggggacggatggacggtcagggtgggaccgggctgggtcgtgcgtgaaggagcacggcggggtgactacgaagtcgtccggcttgacgagcccgcgcgtccgctctcggtcacgacggacgtggtgtacgggcacaaggatggtctggcgctcacgttcgacgtgcatcgcccagcgcagcccaatggcgccgccgtcatcgcgatcgtgagcggcgggtggcaatcgagcgtggagttgagccgtcttatcgtggacggccatctctccccgttgttgaacgagaagggattcaccgtattcgccgtgagacacggcagcagcccgcggtatcccatgtccgcgatcgtggcggacgtgcggcgggccgtccgtttcatccgtcagcacgcgggcgagtacggcgtggaccccaaccgcattggcgtttatggcggcagcgccggcgggcagctcgcgttgctgctcggcacgacagccgactccggggatccgtcggcctctgacgcggtgctcagggaatccagtcgcgtcgcggcggttgtggcgtactttccgcccacggatctctctcgatttgcgaacaagcggtcgttcccggccacggcggcgttgacggaggccgaagcggcggagtactcacccattcgcttcgtctcgcccggggctgctccctcagtcatcgtgcacggcgacgccgacacagtcgtcccgatggtcgagggggagacgatgcacgaggcgctgacgaaggcgggcgtgatcgcgtcgttcattcgcgttgaacgcgctgggcacgcgttcgagggcgccgatctcgagcgggtcaacgccgcaatggtgcagtggttcgagcggcatctcgggagcgcggcgaggtag

SEQ ID NO: 572 - protein, 352 aa, Unknown
  Obtained from environmental sample
MSDSRGATVIPGHGTVYFGPYRASSGWGTLEAEKGVLIASDGGSRRVSAPVRRDDGTFAGDGWTVRVGPGWVVREGARRGDYEVVRLDEPARPLSVTTDVVYGHKDGLALTFDVHRPAQPNGAAVIAIVSGGWQSSVELSRLIVDGHLSPLLNEKGFTVFAVRHGSSPRYPMSAIVADVRRAVRFIRQHAGEYGVDPNRIGVYGGSAGGQLALLLGTTADSGDPSASDAVLRESSRVAAVVAYFPPTDLSRFANKRSFPATAALTEAEAAEYSPIRFVSPGAAPSVIVHGDADTVVPMVEGETMHEALTKAGVIASFIRVERAGHAFEGADLERVNAAMVQWFERHLGSAAR

SEQ ID NO: 573 - DNA, 1887 bp, Unknown
  Obtained from environmental sample
gtggctctacggagcgtgaccgccgtggccatgagcccggacggacagtgggtagcctacacggccaccaggccacgcgacgaggtcgagacccgagcgccggcgttctccgagctgtgggtggtgccggccgccggcggtgagccgcggctgatcgtcggccagccgcacaccgtggccagcccggggtggaccccggacggccgcatgatcaccttcgccgccacgctgccggccgccgagggccgccaggtgtacggcgtggacccggcgggcggcgagccccggccgctgaccgcctcgccgcggggcgtggcggccttcgccctgtcgcccgacggcgggaggatcgcctacaccgagagcgtgccgcagcccgagcacatcgccgagcggcgggcggccggcaacgacgtgatcgtggccagcgagcagggcacgttcatgcgcctcttcgtccagcccatgggcggccaggccaatcccatcaccccggtggaccgggtggtccgcgacttcacctgggctccgggcggggcctggctggcggtccagtggacggaagggaccgacgcggacgcggacctcatgtaccgcgagatgcatggcgtggcggcggacggggcgtggacgcgcccgctggtcgagacggaaggcaagctggggcccatgcggttctcgccgcgcggcgacttcttcgcctggctgggcgccacggagttcaatgacccactggcgcagagtgtgttcgtggttcccatgcgtgacgggcaggccacggccgcgccgcggaacctgacgcccgggcttgaggccagcgccgaggcgctggactggctcgatgaccggacgctctggttcgtggcctcggagagcacccgcacccgcatgtaccgcgtccgccaggacgggacccggctcgagcgggtcatgggcggcggcgccgagatcttccggagcgccagcttcgacgcccggaaccggacgttccccacggccgccaataccgcgcggcacccgaacgaggtgttcgccgccacactgggccgcgacctgcgccggctcacccaccacaacgcctggctggcgaacgtggcgctgggcgagcaggagaccgtggcctgggagggacctgaaggttggatgatcgagggcgtggtggtgcgtccagtcggcttcgtggaaggccagcgctacccgctggcgatcctgccccacggcggccccgagggcgtggacctggacggctggaacaccaaccccctctatccggcgcaggtcctggccggagagggatacgtggtcttcttccccaactaccggggcagtggcggccgcggcgtggtctggagcaagggcgatcaccgcgacctgggcggccgcgagatggaggacatcctgaccgggatcgactacctggccgagcggggctggatcgatccggatcgcgtcgggatcagcgggaccagctacggcggctacctgtcggcctgggccgccacccggcacagcgaccggttccgggcggccatcccgttcgcggggctcacgaactggatcagcttcacggggaccaccgacatccccatcgagatgatgttcgtccactgggacctggacatcttcggcaacttcggcctctacatggaccggtcaccagtctcgcacctggtgggcgcagccacgccgaccctgatcggcaccgggctggccgacgaccgggtccacccggagcagtccatccagctatacgggctgatgcgcctggcgggcatcccggtggagttgttgttgtacccgcgggagccacacgggctgcgtgagcgggctcaccagttggactacatgtatcgggtggtggattggtttgggaggtatttgaggtag

SEQ ID NO: 574 - protein, 628 aa, Unknown
  Obtained from environmental sample
  DOMAIN (416)...(495): Prolyl oligopeptidase family
MALRSVTAVAMSPDGQWVAYTATRPRDEVETRAPAFSELWVVPAAGGEPRLIVGQPHTVASPGWTPDGRMITFAATLPAAEGRQVYGVDPAGGEPRPLTASPRGVAAFALSPDGGRIAYTESVPQPEHIAERRAAGNDVIVASEQGTFMRLFVQPMGGQANPITPVDRVVRDFTWAPGGAWLAVQWTEGTDADADLMYREMHGVAADGAWTRPLVETEGKLGPMRFSPRGDFFAWLGATEFNDPLAQSVFVVPMRDGQATAAPRNLTPGLEASAEALDWLDDRTLWFVASESTRTRMYRVRQDGTRLERVMGGGAEIFRSASFDARNRTFPTAANTARHPNEVFAATLGRDLRRLTHHNAWLANVALGEQETVAWEGPEGWMIEGVVVRPVGFVEGQRYPLAILPHGGPEGVDLDGWNTNPLYPAQVLAGEGYVVFFPNYRGSGGRGVVWSKGDHRDLGGREMEDILTGIDYLAERGWIDPDRVGISGTSYGGYLSAWAATRHSDRFRAAIPFAGLTNWISFTGTTDIPIEMMFVHWDLDIFGNFGLYMDRSPVSHLVGAATPTLIGTGLADDRVHPEQSIQLYGLMRLAGIPVELLLYPREPHGLRERAHQLDYMYRVVDWFGRYLR

SEQ ID NO: 575 - DNA, 1293 bp, Unknown
  Obtained from environmental sample
atgaaacgattgctttgttccttattactggcactctcgcttgttacctacgcccagccgcatatgggcttagcagaagtacccttgcagcctaatgtatcacttcctggcgtatcggcgcaaaggctggctcgcatcgatgggctgctgcaggagtatgtaagcaaaggctggctgcccggcgccgtggccctggtggcaaaagacggcaagatcatttaccataaagcttttggctacagcagcctcgaaacccctacctcgcttcagaaagatgccatcttccgcattgcctcgcaaacaaaagccatcacctcggtaggcatcatgatgctgtgggaagaaggcaagctcgggctcgatgaaccagtttcccgctacattcccgagtttaagaatcctaaagtgctccttgctttcaacgcatccgattcttcttatacaacggttccggccaaaggcgaggtaaccatccgccagttgcttacccatacttccggtattggttatgcacaaattggctcgccggagatgaatgcactgtatgcaaaagccggcgtggtgggcggcattggggtaggcgccattaccctggccgataaaataaaaatattgggcggcctgccgctttttcatcagcccggcgaaaagtggacctatggccttagtaccgatgtgctgggttatgtaatagaagtggtaagcggccgcaacctggaccagttttttgccgagcgcatctttaagccgctgggcatgcaggatacttacttttaccttcccgaaagcaaaagaagccggcttgtaaaattgtattcggaagataagagcaagaaacttgttaaggccagttccgagatgagtcttaatggagcattcaatcccgattacccggcatcggcaggcacctatttttcgggcggcggcggcctgtcggctacggctttggattatgccatttttatgcagatgctgctcaacggcggcacgtacaacggggtacggcttttggccccggccacggtacggctgatgaccaccaaccaggttggcgataaaaccatcgggcggggcaataaatttgggcttggctttgagctggtaaccgaagaaagcaagtgggctacgccgctttcggcaggcagtttttcgtggggtggcatgttttcttcttcgtactggattgatccaaaagaaaaaattgtggcccaactgtttttaaacctttaccccaacagccatggcgaagtgcacgataagtttaagacaatggtgtatgcagcgctggagtga

SEQ ID NO: 576 - protein, 430 aa, Unknown
  Obtained from environmental sample
  SIGNAL (1)...(18)
  DOMAIN (46)...(428): Beta-lactamase
MKRLLCSLLLALSLVTYAQPHMGLAEVPLQPNVSLPGVSAQRLARIDGLLQEYVSKGWLPGAVALVAKDGKIIYHKAFGYSSLETPTSLQKDAIFRIASQTKAITSVGIMMLWEEGKLGLDEPVSRYIPEFKNPKVLLAFNASDSSYTTVPAKGEVTIRQLLTHTSGIGYAQIGSPEMNALYAKAGVVGGIGVGAITLADKIKILGGLPLFHQPGEKWTYGLSTDVLGYVIEVVSGRNLDQFFAERIFKPLGMQDTYFYLPESKRSRLVKLYSEDKSKKLVKASSEMSLNGAFNPDYPASAGTYFSGGGGLSATALDYAIFMQMLLNGGTYNGVRLLAPATVRLMTTNQVGDKTIGRGNKFGLGFELVTEESKWATPLSAGSFSWGGMFSSSYWIDPKEKIVAQLFLNLYPNSHGEVHDKFKTMVYAALE

SEQ ID NO: 577 - DNA, 1860 bp, Unknown
  Obtained from environmental sample
atggcgatatttgattataaaggacaggacgcacgtacactcatctcggatgcctggaccctggctacctacaccagtgggaccgccaccgtgggggccctgtacaacatacccggggcgatccttggagagggcaacagcttttccctgcccaaaggttggcgtgagattaatgccagtgagctggatgtcgataacagccgtctggacattacggggagtttcacgggtgggggtgttttcggtgcccaggccagggtgttcgggcaatacgacagtagtggccagttgactaaaatggcgttctccatagccggcactaactcaccgatcgatctgattggttggccagcgatgatcgataactcctatatcaacggttttgattacctgctcgatgccatcaaggattacgccgttgcaaagaacttgagtggtaaggacgtgctggttaccggttacagccagggaggtgcggtgaccaacggtatgttcctgaccaaggacacgctggcagacggtttcttcaaagactcggattactttggcatggagtcgcccaaagtcggcaacgacagcggcatcttcaacttcggctttgaaaacgacgtggtgcatcgacttatcggcgaagaaaccaacctgggcagcgccgccatcgatgccctgaccggcagtgatatcaactacacctcgaccaccgacaacatcgtgctgtttgacacgatctatgcactgcctacctggcccaacggccctttctccattgccaacctgacaggctgggctgcccacctcgaaggcattttcatcaaccccatccagaccatcagccagtcgacgttctacgatcatatcgagcaggacagcaccatcatcatcagcaatctcgaccccatcagccgcagcttcacctgggtcagcgataaagccaccgcgacctccaaccactacggcacgccggcgttcctgctagggactgccagcggcgataagctacaggatggtcgcagcgatgacttcctcgatggatttgccggcgacgacagcttcagggtcagcactggaaccgatatcgttgccggcggcgcgggcagcgataaggtgtttctcaaaggtgccgtggcgaactacgaagcggtcaagctgagcgacggcacgttgtttctcaacgacacgaccggccaatacgggctcaaggaactgcacagcgttgagttcgttgagtttgaaacggccttggccactgcaaccagccaattgccctttgtcggcggctttctcagcagcgtcggtcaagtgttgaccccggcctatgccgtgaccagcgacaagctggattatcaaggctggttcggctcagacaagtcgtacaacaaagccattgaaggcacggcgcaggccgacagcctcatcggtaccagcggccgtgacctgatgtttggccaggccggtaacgacacactgagcggtggcgccggcaatgacctgctccacggtggcgagggcaatgacacattgctgggcggcactggcaatgaccagctctacggcggcgccggcaacgatatcctggtgggcggccagggcaatgacctgctcagtggtggcgttggcagtgacgtgtttgtattcgaccaggcaggctttggccaggatcggatcagcgacttcaacattcaccagaacgggctggatgtactggtgttttccaagtcgctctttgcctctgtcgatgccgtgctcagtgctgccagccagcaagacaatgacacggtgatccagacgatagacggtagcgtcactctggtgggcttcagcccggcgaatctgaccgcggatatgctcagcctggcttaa

SEQ ID NO: 578 - protein, 619 aa, Unknown
  Obtained from environmental sample
  DOMAIN (490)...(507): Hemolysin-type calcium-binding repeat (2 copies)
  DOMAIN (508)...(525): Hemolysin-type calcium-binding repeat (2 copies)
MAIFDYKGQDARTLISDAWTLATYTSGTATVGALYNIPGAILGEGNSFSLPKGWREINASELDVDNSRLDITGSFTGGGVFGAQARVFGQYDSSGQLTKMAFSIAGTNSPIDLIGWPAMIDNSYINGFDYLLDAIKDYAVAKNLSGKDVLVTGYSQGGAVTNGMFLTKDTLADGFFKDSDYFGMESPKVGNDSGIFNFGFENDVVHRLIGEETNLGSAAIDALTGSDINYTSTTDNIVLFDTIYALPTWPNGPFSIANLTGWAAHLEGIFINPIQTISQSTFYDHIEQDSTIIISNLDPISRSFTWVSDKATATSNHYGTPAFLLGTASGDKLQDGRSDDFLDGFAGDDSFRVSTGTDIVAGGAGSDKVFLKGAVANYEAVKLSDGTLFLNDTTGQYGLKELHSVEFVEFETALATATSQLPFVGGFLSSVGQVLTPAYAVTSDKLDYQGWFGSDKSYNKAIEGTAQADSLIGTSGRDLMFGQAGNDTLSGGAGNDLLHGGEGNDTLLGGTGNDQLYGGAGNDILVGGQGNDLLSGGVGSDVFVFDQAGFGQDRISDFNIHQNGLDVLVFSKSLFASVDAVLSAASQQDNDTVIQTIDGSVTLVGFSPANLTADMLSLA

SEQ ID NO: 579 - DNA, 1524 bp, Unknown
  Obtained from environmental sample
atgaccgtgaaattgttgatcggccccctgctgggcctggaatccgacacgctgtacacggtgtgcttcagcacgtcgcgcgctgccacccgcgccgcagtcacgttcaacggcaacagcgtgaatgcgcttaaagtcggtgacacctacagcaccagcgtatggcgggcggaatggacagcggcgccgcagatcgatccgcgtctggtgcgctacagcgttcacgtggacggcaatctggcccacaatcacgatggcagtgaatggacattctacgtgcccggcagcaaggaaaagccgcgcctgctgtatgcgtcgtgcaacggattttccagcccggatctgatgaccaaaaccgagcgcccgtacatcctgtggggcaagatccgcaaattccagcaagcggaaatggccaaggtgaacacggatgacattcccgcgccctactccctgatgctgctgggcggcgaccagctttacgccgatgaactgtggacgcgggtgccgctgctgcacaagtggagtcacgagcgccacgacaaaaaactcaagacaaaatccagcaaggcactggaagaacagctcgaacgtttttacgacgagctgtaccagtcacgctggaacaaacccgatatgtcgctgatgctggcgtcgatccccaacctgatgatgtgggacgatcacgacatcttcgacggctggggcagcttcccccacgagctgcaggaatgcgaggtgttcaaggcgattttccgggtggcgcgccgctatttcgaactactgcagatccgctcccgtcacaatcgtgcgctgctggatcgcgatgccaatcactacgcctttgccgtgccgtttcgcggctatcagattctggcactggacaaccgcgccgagcgcacccgcaaacaggtgatgagtccgcgccagtggaacagtctgctcgactatctggatcacaaggccacccacggcgatctgctgctgatgtcggcggtgccggtggtgtaccgggatttctcgttcaccgaaaccgtgttcgacaccacaccctgggaagaagaactcaccgacgacctgaaggatcactggcgcgccaaggatcaccagggtgaacgggcgcggctgatcatgcgactgctgaagaacgtcgaactgcgcggcaaaaacaacaacggccattgccgcaccgtgatcctgtccggcgacgtgcacatcggctgcctgggcgtaatccaggatcgccgcgacggcagcaaccgccgcatccatcaggtggtgtcctctggcatcgtgcatccggcgcccagcaagatccagtggtacggcatcatggcagtcaccaacgacgacaccgaatacctgaacgaggacaagagcatcgagatcagaatgatcaagcctcacagctcggaaaaatacctgcgcgtgcgcaactatgtcagcctgctggaaggcagcgacaaaaagctgtggctgaactgggtatgcgattccgacgagaagccggtgtatccgctggactga

SEQ ID NO: 580 - protein, 507 aa, Unknown
  Obtained from environmental sample
MTVKLLIGPLLGLESDTLYTVCFSTSRAATRAAVTFNGNSVNALKVGDTYSTSVWRAEWTAAPQIDPRLVRYSVHVDGNLAHNHDGSEWTFYVPGSKEKPRLLYASCNGFSSPDLMTKTERPYILWGKIRKFQQAEMAKVNTDDIPAPYSLMLLGGDQLYADELWTRVPLLHKWSHERHDKKLKTKSSKALEEQLERFYDELYQSRWNKPDMSLMLASIPNLMMWDDHDIFDGWGSFPHELQECEVFKAIFRVARRYFELLQIRSRHNRALLDRDANHYAFAVPFRGYQILALDNRAERTRKQVMSPRQWNSLLDYLDHKATHGDLLLMSAVPVVYRDFSFTETVFDTTPWEEELTDDLKDHWRAKDHQGERARLIMRLLKNVELRGKNNNGHCRTVILSGDVHIGCLGVIQDRRDGSNRRIHQVVSSGIVHPAPSKIQWYGIMAVTNDDTEYLNEDKSIEIRMIKPHSSEKYLRVRNYVSLLEGSDKKLWLNWVCDSDEKPVYPLD

SEQ ID NO: 581 - DNA, 984 bp, Unknown
  Obtained from environmental sample
atgaaaatcaaaagagtcagcttggcgttcatagtaacgatggctatgctaatctcggcagccggaatcgcttatgccgctaaccaagcggccaaactgattgacgttcctatcaagaaaccgtcggtggagcttatatccggcgtggtgttcgctcagccggccatattcggtgatcctaacttccccttgcacatggacattctgaaaccggataacaaggagcctgttccggctgtgctgttcgttccgggaggcggctttatgtccgccaataaagacagcagcctccagcaaagattcgcgatcgcagagtccggttatctggttgccagtatggaataccgggtcaccccgcagagcactttcccttctccccttgaagacgttaagtcagcggtccgttatttgcgagcgaatgcacaaaagtacaatatcgatccggatcggatcgcggtgatgggcaattccgcaggaggttatctggcggccttcgcgggaaccactaacggtgttgccgagtttgacaaaggagataatctgactcagagcagtaaggtgcaggcagtcatcgacctttacggcctgtctgatctgacgaagattgcggacggattcgccgaagaagtggtagccattcacgattctccgtcggcaccggaaggaatgtgggttcatggaccggcagtgttcgggccaggaggctcgattcactccgatccggccaaagccgccaaggctaacccgatcacctacgtaacgaaagatgctcctccattcctcatcatgcacggcgacaacgacacgctggtttcgcctaagcaaacgcaaattctgcacgaaacgctgatcggcaagggagtcgactccacctattacgtcatcaaaggcgcagggcatggggggccgcactggaaccagacccaggttaccgatatcctggtcgattttttgaacaaaacgtttaagccggccaagaaataa

SEQ ID NO: 582 - protein, 327 aa, Unknown
  Obtained from environmental sample
  SIGNAL (1)...(26)
MKIKRVSLAFIVTMAMLISAAGIAYAANQAAKLIDVPIKKPSVELISGVVFAQPAIFGDPNFPLHMDILKPDNKEPVPAVLFVPGGGFMSANKDSSLQQRFAIAESGYLVASMEYRVTPQSTFPSPLEDVKSAVRYLRANAQKYNIDPDRIAVMGNSAGGYLAAFAGTTNGVAEFDKGDNLTQSSKVQAVIDLYGLSDLTKIADGFAEEVVAIHDSPSAPEGMWVHGPAVFGPGGSIHSDPAKAAKANPITYVTKDAPPFLIMHGDNDTLVSPKQTQILHETLIGKGVDSTYYVIKGAGHGGPHWNQTQVTDILVDFLNKTFKPAKK

SEQ ID NO: 583 - DNA, 756 bp, Unknown
  Obtained from environmental sample
gtgaactgcaaaactttgaaacgctcattgccgatgttactcataggaggtgaaaccggggtattgttcatccacggctttaccggatcgccgcatgactttgaatacatggcgagaaaagttcatgaggcaggcttcacagtttcagtaccgaggcttccaggacacggtacgtgtggggaagatttcttgaagactaccacgaacgattggttgaggaggaccttcgatgcttattacgacttgaaagccatctgtaaagacgtacacatcgtgggactctctatgggtggggtcatagctttgataatggcttcgatcctcaaaccaaaaaagcttgtcacattggctgctgccacacacctcgctgacaatcgaatcaagatcgctcggtttgttagtctcttcaagaaaaaaatcctgaaagaaagctcgcagacttacgatgatccagaatatgaatttctcaacaaagagtattggtctttcaattggcccaagcaagcagcagaactctacaagctcatcaagatggcgagaaaaagtgtggctcagatcgtgtcggatacactcgtagttgcggctcgtaacgacaatttggttcccttagaggccgcacagttcatatacaacaacatacgttctgaaaagaaaaaacttctgatttttgaacaatctgggcacgttctgagcaacgacgtggagaaagaagcggtgactgaagctgtcataaattggttaaaaaatcaaatttag

SEQ ID NO: 584 - protein, 251 aa, Unknown
  Obtained from environmental sample
MNCKTLKRSLPMLLIGGETGVLFIHGFTGSPHDFEYMARKVHEAGFTVSVPRLPGHGTCGEDFLKTTTNDWLRRTFDAYYDLKAICKDVHIVGLSMGGVIALIMASILKPKKLVTLAAATHLADNRIKIARFVSLFKKKILKESSQTYDDPEYEFLNKEYWSFNWPKQAAELYKLIKMARKSVAQIVSDTLVVAARNDNLVPLEAAQFIYNNIRSEKKKLLIFEQSGHVLSNDVEKEAVTEAVINWLKNQI

SEQ ID NO: 585 - DNA, 945 bp, Unknown
  Obtained from environmental sample
atggtttcccccatccgcaaccgtcccgcgtcgtcgaccttcaccgccgaggcccccaagcaggcgcgttcgttcgacctgttcggtggcatcaagagcggcctggagcagctgggccgggacatcaagctgggcgtggacgcgttcgaggcgagccacctgcgcgagctgggccagatcttcgggctgaacacgccgccgccggaccgcgcggatgacggcaagttcgtgggcgccggcggcaagacgtactcgccgagcaccccgctgaaggacatcccgggcgtcaccccgaagaacaacccgaacccgaaggagaccatcctctacgtcaacggcatcatgacgccggtgagcgggcagatgcgcgagatgcaggccatcgcggaccgctcgggcgccaaggtggtgggcatccacaactccacccagggcctgacggcggacctggcgcagtgcctcaccgacaaggcggacaagggcagcaacccgccggtggacacgctcgcggacacgctctactcggagctgaaggccgggcatgacgtgcacctgatgggctacagccagggcggcatcatcaccgcccgggcgctcgcggcggtgcagcggcgcctgcagtcggaggacgggctgaccaaggcgcaggccgagcaggtgatgagccacctgaacgtggagaccttcggcgccgcctccttccgctacgtggacggccccaagtacgtgcactacatcaacaacgcggacgcggtgcccacgctgaccggcctgggcggcgacatcgacccgctcgagttcgccaagcacgcgggccgcgacgccgtcatccaccgcttcaccgacggcaccgtggacctcatcggcaaccacatggtggacacgatgtacatgccgcaccgcgtgcccttcgaggacgcgcgcgcgggcaagttcctggagtag

SEQ ID NO: 586 - protein, 314 aa, Unknown
  Obtained from environmental sample
MVSPIRNRPASSTFTAEAPKQARSFDLFGGIKSGLEQLGRDIKLGVDAFEASHLRELGQIFGLNTPPPDRADDGKFVGAGGKTYSPSTPLKDIPGVTPKNNPNPKETILYVNGIMTPVSGQMREMQAIADRSGAKVVGIHNSTQGLTADLAQCLTDKADKGSNPPVDTLADTLYSELKAGHDVHLMGYSQGGIITARALAAVQRRLQSEDGLTKAQAEQVMSHLNVETFGAASFRYVDGPKYVHYINNADAVPTLTGLGGDIDPLEFAKHAGRDAVIHRFTDGTVDLIGNHMVDTMYMPHRVPFEDARAGKFLE

SEQ ID NO: 587 - DNA, 993 bp, Unknown
  Obtained from environmental sample
atggccgctgaccagcacatcctggccgctcagaccgtgggccgccgcatactcggcgacgttcttgagcaagccgccgaatgcttcgccggcgtagttcttcgcgtaatccttgggacccagcgccgcaagcaggtcgctgaccagatcgccgatggagtcggtgatcagcgtctcccttgggccagacgtgccgcgaaaaccgatgccgatttcctgcaactggcccgcgtcatcgtacttgcccagcacctcgacctgggctgtggtatagccggccttttcgccgaagaacgtgccccgggcgtcgaccttgccggtatacccgagggtgctggcgctgatgggcgtccacccagccttctgcaccgcttcgagcgcggccttctccgaatccgggttccagggaatgcctgggatcacaccctgggagtccgtactgccgagcaatgcgccgaccagagtagccggcaagccgacgcccaggccattgtgctggtagcccacggcaaagccgttatccaggttgtggtaggtatacaacgtgatcgccatggcatcggcaaacaatgctttggagccctcggccccaaggtttttatagtcaaacacgcccatgatattgcctctcttgttgttaaatttatcgagaacgtccatcactctctaaacgcttgccccggtagtgagcgggtttgccacggcaaacccgctctcgggctcagaacgcccagtcgaggctcaagcccacgccatgcaccttgtctttgctcgccaacaggccgttgtagtcaaaattcacccgcgcgtccttgctcaacgccaggcttacgcgagcgcccaccaaggccgcatcacgggccattggcgcactttccacggcaaacgacggaccgcccgaggcaaatgccaggtgctgttcggcgtccacgctgctcaggttgtgctgccagcccaaggtgccggacacctcaagtgtctggtggtcattga

SEQ ID NO: 588 - protein, 330 aa, Unknown
  Obtained from environmental sample
MAADQHILAAQTVGRRILGDVLEQAAECFAGVVLRVILGTQRRKQVADQIADGVGDQRLPWARRAAKTDADFLQLARVIVLAQHLDLGCGIAGLFAEERAPGVDLAGIPEGAGADGRPPSLLHRFERGLLRIRVPGNAWDHTLGVRTAEQCADQSSRQADAQAIVLVAHGKAVIQVVVGIQRDRHGIGKQCFGALGPKVFIVKHAHDIASLVVKFIENVHHSLNACPGSERVCHGKPALGLRTPSRGSSPRHAPCLCSPTGRCSQNSPARPCSTPGLRERPPRPHHGPLAHFPRQTTDRPRQMPGAVRRPRCSGCAASPRCRTPQVSGGH

SEQ ID NO: 589 - DNA, 894 bp, Unknown
  Obtained from environmental sample
atggaaaaaagaagtatcactttaaaaaatggtgaagtctacaagtacgtagaacaaggccaaggggatcaagtgttattactcattcatggtaatttctcatcatcacttcacttcacaccacttttagaaagattaccaaaaaacatcaaagtgattgcaccagatttaagaggatatggtgactctagttattatagacgtataagcagtttaaatgattttgcagaagatgtacatatgtttatggaagcaaaagaaattaaatcatatcatgttgttggatggtcacttggtggtggtgttgcattagaacttgctgcacaccatccagaagctgttgaatcattagtcttaataaattcaacaacacataaaggttatccagtctttaaaaagggcgcagatggaaaaccacttgttggtgaagtctatcaatcagcagatgagatggcaaacgacccagttcaagttttaccgcttttaaaagcacaaaaggataagaactttgactttgtaagttacatctttgatgtgacgatttacacagtaaataaaccatccgtagatgataacaaactttggattaatgaatcattaaaacaaagaaatttaccagatgctgactgggcactagcaaaccttaacatgtcagatcaacacaacttttataacgctggaatgaataacatttcaaaggtgaaagcacctgtgttacacacttggggagataaggatattacagttcctgaatacatgattaaagacaatgtaaaagcattagaagaacaatcaaaattagttgtttatgagaactgtggacattcacctttagttgacgttccagatcaattaacaaaagatattttagattttataggatataaaggatga

SEQ ID NO: 590 - protein, 297 aa, Unknown
  Obtained from environmental sample
  DOMAIN (50)...(291): alpha/beta hydrolase fold
MEKRSITLKNGEVYKYVEQGQGDQVLLLIHGNFSSSLHFTPLLERLPKNIKVIAPDLRGYGDSSYYRRISSLNDFAEDVHMFMEAKEIKSYHVVGWSLGGGVALELAAHHPEAVESLVLINSTTHKGYPVFKKGADGKPLVGEVYQSADEMANDPVQVLPLLKAQKDKNFDFVSYIFDVTIYTVNKPSVDDNKLWINESLKQRNLPDADWALANLNMSDQHNFYNAGMNNISKVKAPVLHTWGDKDITVPEYMIKDNVKALEEQSKLVVYENCGHSPLVDVPDQLTKDILDFIGYKG

SEQ ID NO: 591 - DNA, 981 bp, Unknown
  Obtained from environmental sample
atggcgcgactcaccaggcggggattcgtcagggcgtcgggggcgctcgccgcggcaccggcgttcgcggcgctggcagcacgggcgcaggggccggtgccggacgcggggaatctgcgcgtcgagcgggacatcgtgttcggcaggggcgggagcctggatctcctgctcgacgtctatcgaccgccagagggcgtggcctcgaaacgcctggccatcgtgcacctcttcgggggcggcttcttcaccggcaacaagaacgccggctacatcgtgaatgacgccagggcgctcggggcccgcgggtacacgaacatctcggcgaactatcggctgcagagcgagggttcctggccggcccagatccacgacgtgaaggccgcgatccgctggacgcgcgcgaatgccgggcgcctgggcgtcgacgccgacaagatcgcggtggccgggtactcggccggcggcatgctggcgctcatggccgccggcacgaacggccgggaggagttcgagggcgacggcggcacgccgggcgtcagctcggacgtcaccgcctgcatcggcgtctacccgctcgcgagcgcccagatcgccacggggctcttccccgaggggcaggcgacgcccgagaacatcgcggccgcgtcgcccacgtcctacatcagcgatcgcttcgcgccgacgatcttcatccacggcaccagcgacggcacgatcccggcgcagtcgagcgtcgatttctgggcgaagcttcaggcgctcggcgtgccgtcggcgctgacgctgatccagggcgccgatcatgccttcgacaacagcgccttcgacgcgatcgaggtgatggcgcagtcgatcgatctcttcttcgatcggctgatcgtcaatccgacgccctatccgtcgttcggcgcgggcggcggccgtgggggacgaggcggaggccgcggccagggtggccccgcacccgggggccgggggtag

SEQ ID NO: 592 - protein, 326 aa, Unknown
  Obtained from environmental sample
MARLTRRGFVRASGALAAAPAFAALAARAQGPVPDAGNLRVERDIVFGRGGSLDLLLDVYRPPEGVASKRLAIVHLFGGGFFTGNKNAGYIVNDARALGARGYTNISANYRLQSEGSWPAQIHDVKAAIRWTRANAGRLGVDADKIAVAGYSAGGMLALMAAGTNGREEFEGDGGTPGVSSDVTACIGVYPLASAQIATGLFPEGQATPENIAAASPTSYISDRFAPTIFIHGTSDGTIPAQSSVDFWAKLQALGVPSALTLIQGADHAFDNSAFDAIEVMAQSIDLFFDRLIVNPTPYPSFGAGGGRGGRGGGRGQGGPAPGGRG

SEQ ID NO: 593 - DNA, 1233 bp, Unknown
  Obtained from environmental sample
atgaaatgccgtcggcgtgttgctcttgtgttgctcggattatggtttgtgttctgcctatctgttccgggagggcgagctgaagcggcagcctcacgcgccaatgatgcgccgattgtgcttctccatggctttaccggctggggaagagaagaaatgtttgggttcaagtactggggcggggtgcgcggcgatatcgaacaactgcttaacgcccatgggtatcgaacgtacacgttggcggtcggcccgctctcaagcaactgggaccgggcatgcgaagcgtacgcccagcttgtcggcggaacggtcgattatggtgcggcccatgcggcgaagcacggccatgcgcggtttggccgcacgtatccgggcttgctgccggaattgaaaagaggcggccgcgtccatatcatcgctcatagccaaggaggacagacggcccgcatgcttgtgtctctcctagagaacggaagcaaagaagagcgggagtacgccaaggcgcataacgtgtctttgtcaccgttgtttgaaggcggacatcattttgtgttgagtgtgacaaccattgccactcctcatgacgggacgacgcttgtcaacatggttgatttcaccgatcgcttctttgacctgcaaaaagcggtgttgaaagcagcggctgtcgccagcaatgtgccatacacgagtcaagtatacgattttaagctcgaccaatgggggctgcgccgtcagccgggtgaatcgtttgaccaatattttgagcggctcaaacagtcccccgtttggacgtccgcagataccgcccgctatgatttatccgttcccggtgcggaggcgctgaaccaatgggtgcaagcaagtccgaacacgtattatttgagctttgccacagaacggacgtatcgcggagcactcacaggcaactattatcccgaactggggatgaatgtattcagcgccgccgtatgcgccccgtttctcggctcgtaccgcaatgcggcgcttggcattgacgaccgctggcttgagaacgatggcatcgtcaacacgttttcgatgaacgggccgaagcgtggatcgaccgatcggatcgtgccgtatgacgggacgttgaaaaaaggagtttggaatgacatgggaacgtacaatgtcgatcatttggaagtgatcggcgttgacccgaatccgttgtttgatattcgcgccttttacttgcgccttgccgagcaa

SEQ ID NO: 594 - protein, 411 aa, Unknown
  Obtained from environmental sample
  SIGNAL (1)...(29)
MKCRRRVALVLLGLWFVFCLSVPGGRAEAAASRANDAPIVLLHGFTGWGREEMFGFKYWGGVRGDIEQLLNAHGYRTYTLAVGPLSSNWDRACEAYAQLVGGTVDYGAAHAAKHGHARFGRTYPGLLPELKRGGRVHIIAHSQGGQTARMLVSLLENGSKEEREYAKAHNVSLSPLFEGGHHFVLSVTTIATPHDGTTLVNMVDFTDRFFDLQKAVLKAAAVASNVPYTSQVYDFKLDQWGLRRQPGESFDQYFERLKQSPVWTSADTARYDLSVPGAEALNQWVQASPNTYYLSFATERTYRGALTGNYYPELGMNVFSAAVCAPFLGSYRNAALGIDDRWLENDGIVNTFSMNGPKRGSTDRIVPYDGTLKKGVWNDMGTYNVDHLEVIGVDPNPLFDIRAFYLRLAEQ

SEQ ID NO: 595 - DNA, 1704 bp, Unknown
  Obtained from environmental sample
atgtttcacggcgtgcagccgcggctcgggctggtgacaccggcactggagaccgagcatctcgacgcagcggacggacggtattggttgcggcttgaatggcgcgccctcgcccgggcactgcgtgaaacaggagagcagcgcaatatcgcggtccgcgacgcgctcgcgttccggcaagcccggcgcatgctctacccagccagtgtcgacgacgagcgcggccaggagatcggcgaagggctcgccgcgtacaccggcaccgtactcgcggcggagtctgcggccgacgcgatcgtgagcgcggtcgacctgctgaccggcatcgaggcagcggctctggaggcgagcttcgttcggacgtttgcgtacgtgtcaggacctgcgtacggcctcctgctcgatgcgtcgtcgagcgactggaggcgcagggtgcgcggcagcgacgatctcggcacgctcctgatgcgcgcgctcgcggttcaaccagccaccgatcccacggcgtctgcaacccgatacggcggcggcgagatccgcgcatccgaacagcagcgcgatgatgagcggcagcaacgtatcgccaaattgcgccagcgcttcgtcgacggtccggtgctcgtgatcccaggaggcggcagcggcatgtccgattcccggggcgcgaccgtgattccgggccacgggacggtgtacttcggtccctatcgtgcctcgagcggttggggcacgctcgaagcggagaagggcgtgctgatcgcgagtgacggcggctcgcgccgtgtgtcggcgcccgtccggcgcgatgacggtacgtttgctggggacggatggatggtcacggtgggaccgggctgggtcgtgcgtgaaggagcacggcggggtgactacgaagtcgtccggcttgacgagcccgcgcgtccgctctcggtcacgacggacgtggtgtacgggcacaaggatggtctggcgctcacgttcgacgtgcatcgcccagcgcagcccaatggcgccgccgtcatcgcgatcgtgagcggcgggtggcaatcgagcgtggagttgagccgtcctatcgtggacgaccatctctccccgttgttgaacgagaagggattcaccgtattcgccgtgagacacggcagcagcccgcggtatcccatgtccgcgatcgtggcggacgtgcggcgggccgtccgtttcatccgtcagcacgcgggtgagtacggcgtggaccccaaccgcattggcgtttatggcggcagcgccggcgggcagctcgcgttgctgctcggcacgacagccgactccggggatccgtcggcctctgatgccgtgctcagggaatccagtcgcgtcgcggcggttgtggcgtactttgcgcccacggatctctctcgatttgcgaacaagaggtcgttcccggccacggcggcgttgacggaggccgaagcggcggagtactcacccattcgcttcgtctcgcccggggctgctccctcactcatcgtgcacggcgacgccgacacagtcgtcccgatggtcgagggggagacgatgcacgaggcgctgacgaaggcgggcgtgatcgcatcgttcattcgcgttgaacgcgctgggcacgcgttcgagggcgccgatctcgagcgggtcaacgccgcaatggtgcagtggttcgagcggcatctcgggagcgcggcgaggtag

SEQ ID NO: 596 - protein, 567 aa, Unknown
  Obtained from environmental sample
MFHGVQPRLGLVTPALETEHLDAADGRYWLRLEWRALARALRETGEQRNIAVRDALAFRQARRMLYPASVDDERGQEIGEGLAAYTGTVLAAESAADAIVSAVDLLTGIEAAALEASFVRTFAYVSGPAYGLLLDASSSDWRRRVRGSDDLGTLLMRALAVQPATDPTASATRYGGGEIRASEQQRDDERQQRIAKLRQRFVDGPVLVIPGGGSGMSDSRGATVIPGHGTVYFGPYRASSGWGTLEAEKGVLIASDGGSRRVSAPVRRDDGTFAGDGWMVTVGPGWVVREGARRGDYEVVRLDEPARPLSVTTDVVYGHKDGLALTFDVHRPAQPNGAAVIAIVSGGWQSSVELSRPIVDDHLSPLLNEKGFTVFAVRHGSSPRYPMSAIVADVRRAVRFIRQHAGEYGVDPNRIGVYGGSAGGQLALLLGTTADSGDPSASDAVLRESSRVAAVVAYFAPTDLSRFANKRSFPATAALTEAEAAEYSPIRFVSPGAAPSLIVHGDADTVVPMVEGETMHEALTKAGVIASFIRVERAGHAFEGADLERVNAAMVQWFERHLGSAAR

SEQ ID NO: 597 - DNA, 813 bp, Unknown
  Obtained from environmental sample
atggctacccaacctcgcgaagagatgatctcggtcggcgggatcaaggtgcacacactgatcgggggacacggcgacccggtactcgttctgcacggggccggcggatcgctcggctggcggcgctggctcgaccggctcgccgaaaacttcaccgtgtacgcgccgtcgcaccccggctacgaccggtcggacagtgccgactggatggagagcgtgcgggatatcgcccgcttttacctctggttcctcgatgtcgtgggacaggaccgggtccacgtgatcggttcctccatgggcggctggacggccgctgaattggccgtaatgaatcctcacgtcgtgaaccggctggtgttggtcgatccggtcggcctgaagccggagcagggagagatcctcgacatctttttcctttccccggaggaagtgttcgcgaaggcctactacaacgcggagcaggccccggagtacgcggaactctatggtcagccgccgaccgccgagcagcgggacattcagatgcgcaaccgggagatggcggcccggatcacctggaagccgtacatgcacaatccccgcctgccgcacttcctgccgcgggtgacggtgccgacgctgatcgtctggggccgggaagacgagatcgtcccactggagtgtggggaacagtaccagcggctcctgccgaacgcgacgctccgcgtgatcgaccagtgcgggcactcgccccagatcgagaagccggatgagttcctgagcctcgtcaccgagtttctgggcgtggccagtccggccggcgcaaagcagtga

SEQ ID NO: 598 - protein, 270 aa, Unknown
  Obtained from environmental sample
  DOMAIN (51)...(258): alpha/beta hydrolase fold
MATQPREEMISVGGIKVHTLIGGHGDPVLVLHGAGGSLGWRRWLDRLAENFTVYAPSHPGYDRSDSADWMESVRDIARFYLWFLDVVGQDRVHVIGSSMGGWTAAELAVMNPHVVNRLVLVDPVGLKPEQGEILDIFFLSPEEVFAKAYYNAEQAPEYAELYGQPPTAEQRDIQMRNREMAARITWKPYMHNPRLPHFLPRVTVPTLIVWGREDEIVPLECGEQYQRLLPNATLRVIDQCGHSPQIEKPDEFLSLVTEFLGVASPAGAKQ

SEQ ID NO: 599 - DNA, 1425 bp, Unknown
  Obtained from environmental sample
atgggtatctttgactataaaaacctcggtaccgaggactccaaggcgttgttcgccgatgccatggcgatcacgctgtattcctaccacaacctggataacggctttgccgtcggttaccagaacaacggcctcgggctgggcttgcctgccaccctggtcagcgcgctgattggcggcagcaatgcccaaggggtcatccccgggatcccctggaaccccgactcggaaaaagccgccctggaggcggtgcaagcagccggctggacgcccatcagcgccagtaccctgggctacagcggcaaggtcgatgcgcgcggcaccttctttggcgaaaaattcggctacggcacggcgcaggctgaggtgctgggcaagtacgatgatgcgggcaagctgcaggaaatcggcatcagttttcgcggcacttcggggcctcgggaaagcgtgatcaccgactccatcggcgatgtgatcagcgacctgctcgccgccttcgggcccaaggattatgccaagaactacgcgggggaagccttcggcggcttgctcaaaaacgtggcggactacgccagtgcccagggcctgggcggcaatgacgtggtggttagcggccacagccttgggggcctcgcggtcaacagcatggccgacttgagcgacaacagctggtcggggttctataaggactccaactacgtggcctacgcatcgccgacccagagcgccggcgacaaggtgcttaacgtcggctatgaaaacgacccggtgttccgcgccctggatggctcgtcattcaacctgtcgtccctgggcgtgcacgacaagccccacgagtcgagcaccgacaacatcgtcagcttcaacgaccactacgcttcatccctgtggaacctgctgccattttccatcctcaacctgcccacctgggtctcgcacttgcccaccggttacggcgacggcatgacccgcatcctcgactcgggcttctacgaacagatgacccgcgactcgacggtgatcgtcgccaacctgtccgatccggcacgggccaccacctgggtgcaagacctcaaccgcaatgccgaggcgcacaagggcaataccttcatcattggcagtgacggcgacgacttgatcaaaggcggcaggggcgcggactttatcgaaggtggcaagggcaatgacaccatccgtgacagcagcgggcataacacgtttttgtttagcgggcagtttggcaatgaccgggtgattggctaccagacgacggacaagctggtgttcaacgacgtggcgggcagcaccgattaccgcgaccacgtcaaggtggtgggcgcggataccgtcattagctttggtacggattcggtgacgctggtgggtgtgagcagtctgtcgggggaggggatagtcatcagctaa

SEQ ID NO: 600 - protein, 474 aa, Unknown
  Obtained from environmental sample
  DOMAIN (133)...(265): Lipase (class 3)
MGIFDYKNLGTEDSKALFADAMAITLYSYHNLDNGFAVGYQNNGLGLGLPATLVSALIGGSNAQGVIPGIPWNPDSEKAALEAVQAAGWTPISASTLGYSGKVDARGTFFGEKFGYGTAQAEVLGKYDDAGKLQEIGISFRGTSGPRESVITDSIGDVISDLLAAFGPKDYAKNYAGEAFGGLLKNVADYASAQGLGGNDVVVSGHSLGGLAVNSMADLSDNSWSGFYKDSNYVAYASPTQSAGDKVLNVGYENDPVFRALDGSSFNLSSLGVHDKPHESSTDNIVSFNDHYASSLWNLLPFSILNLPTWVSHLPTGYGDGMTRILDSGFYEQMTRDSTVIVANLSDPARATTWVQDLNRNAEAHKGNTFIIGSDGDDLIKGGRGADFIEGGKGNDTIRDSSGHNTFLFSGQFGNDRVIGYQTTDKLVFNDVAGSTDYRDHVKVVGADTVISFGTDSVTLVGVSSLSGEGIVIS

SEQ ID NO: 601 - DNA, 951 bp, Unknown
  Obtained from environmental sample
atgcgaacccgtactttcggcgcggtgattctcggggctctactcgtactgtgcgtcggatgctcccgtcgaaccgtgcccggagcggacatggcttcacctccacgccagctgctgaccccggcagagctccaggccttgccggtgcaggccccggatcagcgactcgcgtacggggaggagcccagccagtatggcgaattgcgggtgccatcgcacggtgggcctcaccctgtcgtggtcctcattcacggaggctgctggaaagagccctacgccacactccgcgacctcgctccgatgggcgatgcattgaaagcggagggcgtggcgacctggaacatcgaataccggcgactttaccagccgggcagcgggtggccgggcacgtacctcgacgtggggcgcgcggtcgatcacctccgcgcaattgccgcacagtaccccctcgatctcgaccgcgtcgttgttgtaggtcattcggccggtgggcacctggcgatgtgggtggcggcgcggacccgtctggggagagagagccccctcttcgtcgctgacccactgccggtgcgcggcgtcatcaacctggccggcaggatcgatatggccgacaacatcgcggcgtacgaggccgcgtgcggcgatactgtcgtcactgctatgctgggtggcacacccgccgaggtgcctgagcgctacaccgaagtctcggcgatcacgagcgttccactcggcattccccaggtgctcatctggggcgagcacgaggagttcgtgccctttgccgtcgtgcagaagtacgtgcgaacggccacgcaggctggagattccgtgcggctggtggtgattcccagcgtcggtcatttcgagactgccagcccgttctcttccgcgtggcccaccgtgcgatcggcgattcgatcgctgctcgagggccggctgccgcagtga

SEQ ID NO: 602 - protein, 316 aa, Unknown
  Obtained from environmental sample
  SIGNAL (1)...(32)
MRTRTFGAVILGALLVLCVGCSRRTVPGADMASPPRQLLTPAELQALPVQAPDQRLAYGEEPSQYGELRVPSHGGPHPVVVLIHGGCWKEPYATLRDLAPMGDALKAEGVATWNIEYRRLYQPGSGWPGTYLDVGRAVDHLRAIAAQYPLDLDRVVVVGHSAGGHLAMWVAARTRLGRESPLFVADPLPVRGVINLAGRIDMADNIAAYEAACGDTVVTAMLGGTPAEVPERYTEVSAITSVPLGIPQVLIWGEHEEFVPFAVVQKYVRTATQAGDSVRLVVIPSVGHFETASPFSSAWPTVRSAIRSLLEGRLPQ

SEQ ID NO: 603 - DNA, 1575 bp, Unknown
  Obtained from environmental sample
atgcgcaagatgctgctgctgttgatcctgttgaccggcctgtcacctgccgcctgggcggtgaccgtcaccaccacccatcagacgatacccagctgggacggaacaccgctcggggtattcgtcatccagccgcaggggcagggcgagggacgccttccgctgctggtcatgcccagcagttgggccgttcccagcgtggaatatgtcggcgtcgcgcaggcgctggcccagcgtggctatatcgtgctcagctacagttcgcgcggattctgggagtcgggtggggcgatcgacatcgccggacccgccaccgtcgaagatgtcagcgcgctgatcgactgggcgctggacaacacccgggccgatcccgcccgcatcggtgtgtccggcatctcctacggcgccggcaccagtctgctggcggcggcgcgtgatccgcgcatcaaggcggtggccgcactgagcggctgggccgacctgcaggcggcgctgtacagcaacaacacgcccagcgcgcagggcattgccctgctggtggccgccggcatggccaccggtcgtcccggtgaggagctggccacgatcaaccgcaaggtggtgaccggcaacttccagggcgcggtggaatcgctgctgccggttgcggcactgcgcagtccgtccgccagcgtggcggagatcaacgccaaccgccccgccattttcctggccaatgccttcaacgacagcctgttcccgcccggccagctggtggacttcttcaatgcgctgaccggtcccaagcagctgcagctgcgtcatggcgatcacgccctcaacgaggcgctgggtgcgctgggggtgccgaatgaggtctacgcctcggtgggggactggttcgatcactacctcaagggcgtggcgaacggcatcgaccgtgccccggccgtgcagctgaagtcgcagaagggcagctggaacacctatgcagactggcaggcgacccgtgccggcgcgacccagtacgcgctgaccgcgccgggcggactgctgcttcccacgggtggcctggtcgagaacgggcgcagcagcggctggagctaccgcatcggcagtggcctgccgaccgccgccaactccggtgtcgcgatggtgtccggctccctgcagatgatcaacgttgcgcctggcgcctacgtgcccttcatcggccgcaatgccgccggcgtctggcagagcccggtctactggagcgcccgtcgcatggacggcatgccggaagtgcgcgtcaccgtcacccccagccgggccgacaccacgctctatgcgtatctgttcgtcgaggacgtcctcggcaacgggcagctgatcagccacaagccgtacaccctgcgcagcgcgaccccagggcaggcccgcacgctcgatctgcgtcttgaagcgagcagctggaacatcccggccggaagccggctgaccctggtgatcgacaccgtggacctgcgctatgccggcgtcagccagctgggcggaacggtcgccttcagttccccggccaacgcaccttcagtcctgcgggtgcccttgcactga

SEQ ID NO: 604 - protein, 524 aa, Unknown
  Obtained from environmental sample
  SIGNAL (1)...(20)
  DOMAIN (34)...(520): X-Pro dipeptidyl-peptidase (S15 family)
MRKMLLLLILLTGLSPAAWAVTVTTTHQTIPSWDGTPLGVFVIQPQGQGEGRLPLLVMPSSWAVPSVEYVGVAQALAQRGYIVLSYSSRGFWESGGAIDIAGPATVEDVSALIDWALDNTRADPARIGVSGISYGAGTSLLAAARDPRIKAVAALSGWADLQAALYSNNTPSAQGIALLVAAGMATGRPGEELATINRKVVTGNFQGAVESLLPVAALRSPSASVAEINANRPAIFLANAFNDSLFPPGQLVDFFNALTGPKQLQLRHGDHALNEALGALGVPNEVYASVGDWFDHYLKGVANGIDRAPAVQLKSQKGSWNTYADWQATRAGATQYALTAPGGLLLPTGGLVENGRSSGWSYRIGSGLPTAANSGVAMVSGSLQMINVAPGAYVPFIGRNAAGVWQSPVYWSARRMDGMPEVRVTVTPSRADTTLYAYLFVEDVLGNGQLISHKPYTLRSATPGQARTLDLRLEASSWNIPAGSRLTLVIDTVDLRYAGVSQLGGTVAFSSPANAPSVLRVPLH

SEQ ID NO: 605 - DNA, 921 bp, Unknown
  Obtained from environmental sample
atggggaacgagcggaggaacaggccggacgggaacccggtgtgggaggttgccgggcgggcggctcgggcggtgggggtgctggttttggcgctggcgctgagccagtgcgcggcgagggcccccggggtggcgcgggtggcgacggtgacgcgggacgtggtttatacgccggcggcgtggccggaggagatccaggcagacctttaccggccggtggagagcgagctggctcctgcggtggtgttgatccatgggggcgggtggacgacgccggacctgcgctggcagatgcgcgggatcgcgcgggatctggcgaagagggggtattttgtgatgaatctgacctatcgcagcgcggaggactgggtgtatcccgcgccggtggacgacgtgggtgcggcgctggattggatcgaggcgaatgcggcggagcatgggatcgatgcgcggcggatcgcgacgtttggttactcggcgggggggcatctggctttgttgagcgggttgcgggacacgcgggtgaaggcgatcgtagcgggggcggcgccgagcgatcttatgctcttcgacggcgggcggctggtgcaggcgttcatcggcgggacgcggcaggagtttccggagcgttaccgcgcggcttcgccggtgcatcaggtgcggccgggggctccgccggttttcctctatcatggggtgcgggacgggctgattccggcgtttcactcggagatcatgagcggcgcgctggcgcaggcgggggtgcctcacgaggtgtatttcctgaggcggaagaatcacgtcacggcgttcatgttcgggagcgaggcgacggatcgggcgatcgattttttggaccggacgttgagggtgtcgcgcttgccgggtgggggcgggtctgagagaggcggtgggcgatga

SEQ ID NO: 606 - protein, 306 aa, Unknown
  Obtained from environmental sample
MGNERRNRPDGNPVWEVAGRAARAVGVLVLALALSQCAARAPGVARVATVTRDVVYTPAAWPEEIQADLYRPVESELAPAVVLIHGGGWTTPDLRWQMRGIARDLAKRGYFVMNLTYRSAEDWVYPAPVDDVGAALDWIEANAAEHGIDARRIATFGYSAGGHLALLSGLRDTRVKAIVAGAAPSDLMLFDGGRLVQAFIGGTRQEFPERYRAASPVHQVRPGAPPVFLYHGVRDGLIPAFHSEIMSGALAQAGVPHEVYFLRRKNHVTAFMFGSEATDRAIDFLDRTLRVSRLPGGGGSERGGGR

SEQ ID NO: 607 - DNA, 777 bp, Unknown
  Obtained from environmental sample
atgcttgtcaagacacttgtcgccatagcgatgatcgcggttgtcgtgccggtcgtcatgatcggcggcattccgctgcagatcctgctcggtgtcatcgcggcgatggctgcttttgaaaccgcccgtctgtttgacaaaaacccgtgggtcatggcagccctgggcttctttgcgatcgcggccctttactatgtgccggccagccacctggcggcggtgattgccgcatggctggtggtgctgtttgggattgagcttgcggatgagaatgtcacgactgatcttgtcacctataccttcacgatgacgatgctcactggtcttgcgatccgctgcgtgcagcagctgtataccgacagcgcgaccgctgtctatgtgctgctttatattgcctttgcctgcttcggctgcgatacaggcgcttatttcttcggcgttttcttcggaaagcacaagatgattccgcgcgtttccccgaacaagacatgggagggagccatcggcggctacgcgaccggtgccgtgatgtcctttgtctggggtatcttattctgtgcccatctgccgctgacgctgcgccttgccggaagcctgatcctgccggcggtcgcccagctcggcgatctggctttctcaagcatcaagagaagattcggcgtcaaggacctcggcaatatcttcccgggccacggcggcattcttgaccgggtagactcgattatcttctgcctgatggtattcaacggacttatgatcctgtgggggctcgcatga

SEQ ID NO: 608 - protein, 258 aa, Unknown
  Obtained from environmental sample
  SIGNAL (1)...(37)
  DOMAIN (1)...(255): Cytidylyltransferase family
MLVKTLVAIAMIAVVVPVVMIGGIPLQILLGVIAAMAAFETARLFDKNPWVMAALGFFAIAALYYVPASHLAAVIAAWLVVLFGIELADENVTTDLVTYTFTMTMLTGLAIRCVQQLYTDSATAVYVLLYIAFACFGCDTGAYFFGVFFGKHKMIPRVSPNKTWEGAIGGYATGAVMSFVWGILFCAHLPLTLRLAGSLILPAVAQLGDLAFSSIKRRFGVKDLGNIFPGHGGILDRVDSIIFCLMVFNGLMILWGLA

SEQ ID NO: 609 - DNA, 963 bp, Unknown
  Obtained from environmental sample
atgcgccgtatcgcgcggtcaattaattttcgtttgctgttcgcggcgatggcgttcgtcgttgcgccggcaacatcggcccaggcgcaaaacgacaagatgacacccatcgctactcccgcacagcccaatgcgatcgagatcggcaccggtccgctgcccgatgcgaagaaccccgagtcctggcatagccagtacggcagcaagtttgcccgcaacgtaacgattgcgacgctgacaccatttctgccggatgctgccagggccagcggcgccgcggtcatcgtggcgcccggcggcggtttccgcaccttgtccatggaaaatgaagggtggaacgtcgcgcgcgccttggccgaaaagggcgtcgctgcgttcgtcctgaagtatcgattgaatcagactccggcggacatgccgggcttcgagcagtccatgcgagaaatgttttcgggaacagcgcggccgccgcgccccgacccagcgaaggctatcgccggtctcgctccgcaaatcgccgatgcccgcgcggcatttgcactaatcaggaaacgttcttccgaatggcacgtcgatcccaaccggatcggcatggtcggcttttccgccggcgctatgttgaccatggcgaccgcgctcgcgggcgaggatgcgaagccggctttcatcggcaacatctacggtccgctcgccccggtcaccgtgccggccgacgcgccgccattattcatcgcgcttgctgccgacgatcctttcttcgcgaacggcggctttgggctcatcgatagctggaagacagcgaagcggcccgtcgaattccatctttatgaacagggtggccatggcttcgggatgtatccgaaagaaacgacgagcaccggctggttcgaagccttcgtgcggtggattggaatgcacggcatgcttaagccggcagcgtcaggaagcggcggcgcgaagtag

SEQ ID NO: 610 - protein, 320 aa, Unknown
  Obtained from environmental sample
  SIGNAL (1)...(29)
MRRIARSINFRLLFAAMAFVVAPATSAQAQNDKMTPIATPAQPNAIEIGTGPLPDAKNPESWHSQYGSKFARNVTIATLTPFLPDAARASGAAVIVAPGGGFRTLSMENEGWNVARALAEKGVAAFVLKYRLNQTPADMPGFEQSMREMFSGTARPPRPDPAKAIAGLAPQIADARAAFALIRKRSSEWHVDPNRIGMVGFSAGAMLTMATALAGEDAKPAFIGNIYGPLAPVTVPADAPPLFIALAADDPFFANGGFGLIDSWKTAKRPVEFHLYEQGGHGFGMYPKETTSTGWFEAFVRWIGMHGMLKPAASGSGGAK

SEQ ID NO: 611 - DNA, 1071 bp, Unknown
  Obtained from environmental sample
atgggtgcgaataatccggtcacaaaatttgtaatggataaggggcagggcactgcagcacgtttgctggattgcctgccgagctttgcacaagaacgtctggtaaaagcattggattatccttatgactatcctgatttggatccttatataaaatgcttgatggcgattcagattaaacagggagagcacagttttattagtgcagatgcggtgcagtcacgtcaactgtttgatgaacgcatgaaagctattcaggcgaaaccgacgccggtcaaggcagtcgaggatctgcgtttgccattgcaaaatggcactatctttgcccgacattatcatccggcaccacagaaaaaattgccgatggtcattttctatcatggtggtgcatttatagtgggtggtctggatacgcatgatgagttctgccgtttattggcggtgcatgccaaggtgcaggtactcagcgtggcttatccgctaacgcccgaatacagtcctttgcagatggtacaggtctgtgaagatgctctggcttgggtacatcaaaacatcaagcagttgaaaatctataaaaaccagattgtagtggcaggggatagtgcaggtggaaatctggcggcagtggttgcgcagcggagtgccgataaaatctatgcacctcgcgcacagttattgctttacccggctgtcgattttaaaagccgccatccttctttttatgcatacaatcagggcctggtactttcagctcaggatattgatctggtgaccaagctatatgctgaaacacatcaggtcgaactggatgatccgctgatttcaccgacctatggtgaactgaagaatctgccgcctgcctatgtgattaccgcccgtcatgatgtgttgcatgatgagggttcaatctatgcgctgaagttacgtgagaatggggtgcgagtgtattatcaggagtatacggatcaggcccacggttttatcaatctgaccccaattcataaacgttcgaaaaagcaggtcattgaactcagcaagaatttccgtaaattcctggataaaaagatctga

SEQ ID NO: 612 - protein, 356 aa, Unknown
  Obtained from environmental sample
MGANNPVTKFVMDKGQGTAARLLDCLPSFAQERLVKALDYPYDYPDLDPYIKCLMAIQIKQGEHSFISADAVQSRQLFDERMKAIQAKPTPVKAVEDLRLPLQNGTIFARHYHPAPQKKLPMVIFYHGGAFIVGGLDTHDEFCRLLAVHAKVQVLSVAYPLTPEYSPLQMVQVCEDALAWVHQNIKQLKIYKNQIVVAGDSAGGNLAAVVAQRSADKIYAPRAQLLLYPAVDFKSRHPSFYAYNQGLVLSAQDIDLVTKLYAETHQVELDDPLISPTYGELKNLPPAYVITARHDVLHDEGSIYALKLRENGVRVYYQEYTDQAHGFINLTPIHKRSKKQVIELSKNFRKFLDKKI

SEQ ID NO: 613 - DNA, 834 bp, Unknown
  Obtained from environmental sample
atgacatttccaatcattctggcgcacggagtctgccggttcgacgtggtgacgaatgatctgctcaaactcgacaacaacgatgaccccacgctcgatcggttgcactattttcggggtattcgcaccatgttgaaagccaatgggttttgcgtctaccactccaacgtcgggtgggccgccgatgtcaaaacccgggcagaaggcttgagaatcaacattgaagaggtgttgagaaaggaaaatgccaggaaggtaaacatcatcggccacagcatgggcgggctggacagccggcacatgctgttcgatgggcgaaactcgaaccggattcacgaacggattgcatcgttgaccacgatctcaaccccgcacgaaggttctcctttcgccgattggggcattgacaatctgccgcaggtgattccggccgccagactgctcggattggatctgaaggcactcagtgacctgcgaaccgaccggtgcgtggcgttcaacaacgatccggaggtggtcggattcgaacaggaatgcgagaaaacaatccggtttcaaacctatgccggaaaacagaaattctggggcatttttgaagcgttgaaactgccgttttacatcatcgaaaagcgtgaaggcgaaaatgacggcctggtgtcggtgaagtccgccaagtggagagaacgttatttcaagggaacaatcgacgatacggaccatctgaacgagttgggctggtgggagccggcgcaggtctatgcgggtgaaggcccagaccaactgctgaaaaggatccacaagctctatttggaaattgcgcaaggccttccttag

SEQ ID NO: 614 - protein, 277 aa, Unknown
  Obtained from environmental sample
MTFPIILAHGVCRFDVVTNDLLKLDNNDDPTLDRLHYFRGIRTMLKANGFCVYHSNVGWAADVKTRAEGLRINIEEVLRKENARKVNIIGHSMGGLDSRHMLFDGRNSNRIHERIASLTTISTPHEGSPFADWGIDNLPQVIPAARLLGLDLKALSDLRTDRCVAFNNDPEVVGFEQECEKTIRFQTYAGKQKFWGIFEALKLPFYIIEKREGENDGLVSVKSAKWRERYFKGTIDDTDHLNELGWWEPAQVYAGEGPDQLLKRIHKLYLEIAQGLP

SEQ ID NO: 615 - DNA, 1197 bp, Unknown
  Obtained from environmental sample
atgaacgcaacctccgcaacgatcgccgccaccgacacccagcagcgcggtggcttcgccggcaccgatccgcaaccggtcgatcgggtgctggccgcactgatccaggacaactacgaccgcgtcgaccagcgtcgcggcgacccgccgatcgaccgcccgctgccgcagggctgggcgcgcatgggcgacgacgaagtgcgcgccgcgggcatcgatcctgcgatgcagcacgatgccaagagcggcttcgacgcctcgttctaccgcgacgaccagggccgggtggccctggtctatgccggcagcgacgagggccaggactggaagcacaacttcggccagggcctgggtttccaggacgcgcagtacgaccaggcgatcgcgctggcgcgcgaggcgaaatcggccttcggcgaccagctcgtgctgtcgggccagtcgctcggcggcggcctggccgcggcagcgtccatggtcaacgaggtgcccgcggtgaccttcaacgccgccggcgtgcacgaccacacggtcgagcgctacggcctggacgcggacgcggtcaagcgccaggcggaccagggcctggtccggcactacgtggtcgagaacgacatcctgacccacctgcaggagaacgcgttcccgctcaatgcggcgatgccggatgcgcccggcgcgcgcatcgacctgcccgatccggatccgctgaccacgttcgagaagctgctgccctggaagacctggccgcaccgcgtgcataaccactacatcgaggcggtgatcgagtccatggacaaggccggctacacgctcgaaggcgcggcggcgacgcgggatgcgtcgcaggacaccgccaaccggctgctcgacgattcggtgcgcgggctcgcgccgcagcgcgaacgcctcgggctgcaggacgacgaccgcttcttcaacgcggccgccggcatggccgcctcggccggacgcgatggcctgcgcagcatccagcacgtggtcgccacgcccgacggccacggcgtgttcgcggtcgaaggcgacctgcgcgacgccggccaccgccgcagcctggtcgacgtggaacgcggcgccgcgacgccggtcgaggacagcgtggccagcctgcgcgagcacgcctcgcgttccccggagcaggagccgcagcgggagcgccacctggcgatggcctga

SEQ ID NO: 616 - protein, 398 aa, Unknown
  Obtained from environmental sample
MNATSATIAATDTQQRGGFAGTDPQPVDRVLAALIQDNYDRVDQRRGDPPIDRPLPQGWARMGDDEVRAAGIDPAMQHDAKSGFDASFYRDDQGRVALVYAGSDEGQDWKHNFGQGLGFQDAQYDQAIALAREAKSAFGDQLVLSGQSLGGGLAAAASMVNEVPAVTFNAAGVHDHTVERYGLDADAVKRQADQGLVRHYVVENDILTHLQENAFPLNAAMPDAPGARIDLPDPDPLTTFEKLLPWKTWPHRVHNHYIEAVIESMDKAGYTLEGAAATRDASQDTANRLLDDSVRGLAPQRERLGLQDDDRFFNAAAGMAASAGRDGLRSIQHVVATPDGHGVFAVEGDLRDAGHRRSLVDVERGAATPVEDSVASLREHASRSPEQEPQRERHLAMA

SEQ ID NO: 617 - DNA, 933 bp, Bacteria
atgccgctcgatcccgtcattcagcaggtgctcgatcaactcaaccgcatgcctgccccggactacaaacatctctccgcccagcaatttcgttcccaacagtcgctgtttcctcctgtcaagaaggagcccgtggccgaggtccgagagtttgacatggatctgcctggccgcacgctcaaggtgcgcatgtaccgcccggagggcgtcgaaccgccctaccccgcgctcgtgtattatcacggcggcggttgggtcgtcggagacctcgagacgcacgatcccgtctgccgcgtcctcgcgaaagacggccgcgcggtcgtgttctccgtcgactaccgcctggcgccggagcacaagttccctgccgccgtggaagacgcctacgacgcgcttcagtggatcgcggagcgcgcagcggactttcatctcgatccagcccgcatcgcggtcggcggagacagcgccggagggaatcttgccgctgtgacgagcatccttgccaaagagcgcggcgggccggccatcgcgttccagctgctcatctacccttccacggggtacgatccggctcatcctcccgcatctatcgaagaaaatgcggaaggctatctcctgaccggcggcatgatgctctggttccgggatcaatacttgaacagcctggaggaactcacgcatccgtggttttcacccgtcctctacccggaattgagcggcttgcctccggcgtacatcgcgacggcgcagtacgatccgctgcgcgacgtcggcaagctttacgcggaagcgctgaacaaggcgggcgtcaaggtcgagatcgagaacttcgaagatctgatccacggattcgcacagttttacagcctttcgcctggcgcgacgaaggcgcttgtccgcattgcggagaaacttcgagacgcgctggcctga

SEQ ID NO: 618 - protein, 310 aa, Bacteria
MPLDPVIQQVLDQLNRMPAPDYKHLSAQQFRSQQSLFPPVKKEPVAEVREFDMDLPGRTLKVRMYRPEGVEPPYPALVYYHGGGWVVGDLETHDPVCRVLAKDGRAVVFSVDYRLAPEHKFPAAVEDAYDALQWIAERAADFHLDPARIAVGGDSAGGNLAAVTSILAKERGGPAIAFQLLIYPSTGYDPAHPPASIEENAEGYLLTGGMMLWFRDQYLNSLEELTHPWFSPVLYPELSGLPPAYIATAQYDPLRDVGKLYAEALNKAGVKVEIENFEDLIHGFAQFYSLSPGATKALVRIAEKLRDALA

SEQ ID NO: 619 - DNA, 1710 bp, Unknown
  Obtained from environmental sample
atggctgacaacgagttgcccctggcgcggcccagggagacgccgccgtgccgccccggcacgttcgagcttgggctcgccctggctggcgcggtctctggcggcgcctacgccgcgggagtcctggatttcttctacgaagccctcgagcattggtacgaggccagggaggcgggagcgccggtgcccaaccacgacgtgctcctccggatcatctcgggtgcgtcggcgggcagtatcaatggcgtgctttcgggcatcgcgctgccgtaccgttttccccacgtgcacagcgggcccgcgcccgagggtgccacgggcaaccccttctacgacgcctgggtgaagcgcatcgacgtgcgcgaactgttgggcaacgaagacctggccgatcccacgcagccggtggcatccctgctcgacgccacctgcctggatacgatcgcgaaggacatgctcggcttctcggcggcgccggccacccggccgtacgtcgctaatccgctgaaatgcgtgttcacggtgaccaacctgcgtggcgttccttacgtcgtgcagttcaagggaaacccggagatccccggccacggcatgatggcccacgccgactggctgcgcttcgccgtcgacaccgggcagggcgaccgggatggggaatggatgttccccgatgaacggctcgtcagcgggccgagccatgcgcggactccggcctggcaaggtttcatggaggcggcgctcgcttcgtcggcgttcccggccggcttgcgtttccgcgaagtcgcccggccctggagcgattacgaccagcgcgtcgtggtggtgcccaaccaggcgggggccgcggtcccggtcccgctcccgccggcctgggcggagggcgagggcagcgatggggactaccggttcgtcgcggtggatggtggcgcgatggacaacgagccgttcgaacttgcccgtaccgagctggcgggcacgctcggccgcaatccacgcgaagggaaccgggtcaaccgcatcgtgatcatgctcgatccgtttcccgaggccgaggcgccgggacccgcggaagccgcgagcacgaatctcgtcgaggcgatggcctcgctgtttggtgcgtggaaacagcaggcacggttcaagccggaggaagtggcgctcgccctggattcgaccgtgtacagccgcttcatgatcgcgcccagccggccgtgcatggagggcgggccacggtggatcggtgggcgagcgctcgccgcgggtgcgctgggtggcttctcggggttcctggcggaggcatacaggcaccacgatttcctcctgggacgccgcaactgccaacgcttcctcgccgagcgcctgttgatccccgcggacaatccgatcttcgccggctggatcgacgatccctccctgcagggctacatccgcgagatcgatggcgtgcgttacgccccggtcatcccgctggtgggcggctgccagggcttgcgcgagccgttgcccacgtggccgcgtggtgcattcgacctggactcgctcatgccgctggtcgagcgccgcatgcagcgcctgtattcggcggctaccgcgacgctcggtggccgcttcgccacctggctggcgtggcgcttctacctgcgccgcaagctcctcgacctggtctcaagccgtatccgtagcgcattgagggacttcggcctttggtga

SEQ ID NO: 620 - protein, 569 aa, Unknown
  Obtained from environmental sample
MADNELPLARPRETPPCRPGTFELGLALAGAVSGGAYAAGVLDFFYEALEHWYEAREAGAPVPNHDVLLRIISGASAGSINGVLSGIALPYRFPHVHSGPAPEGATGNPFYDAWVKRIDVRELLGNEDLADPTQPVASLLDATCLDTIAKDMLGFSAAPATRPYVANPLKCVFTVTNLRGVPYVVQFKGNPEIPGHGMMAHADWLRFAVDTGQGDRDGEWMFPDERLVSGPSHARTPAWQGFMEAALASSAFPAGLRFREVARPWSDYDQRVVVVPNQAGAAVPVPLPPAWAEGEGSDGDYRFVAVDGGAMDNEPFELARTELAGTLGRNPREGNRVNRIVIMLDPFPEAEAPGPAEAASTNLVEAMASLFGAWKQQARFKPEEVALALDSTVYSRFMIAPSRPCMEGGPRWIGGRALAAGALGGFSGFLAEAYRHHDFLLGRRNCQRFLAERLLIPADNPIFAGWIDDPSLQGYIREIDGVRYAPVIPLVGGCQGLREPLPTWPRGAFDLDSLMPLVERRMQRLYSAATATLGGRFATWLAWRFYLRRKLLDLVSSRIRSALRDFGLW

SEQ ID NO: 621 - DNA, 1293 bp, Unknown
  Obtained from environmental sample
atgttgacacggagagaattgattgcagcgactgccctggggctcgccgctagtacgaaacttgttgctgctgccacgagtaaaaccagggatgatttcctttggggggtggccacggcgccacaccaaatcgagggcaacaacctgaatgccgacctgtggctggccgaacaggtgaagccgacgatctttcacgagccttcgggcgatgcctgtgacagctaccatcgctatgaggaggatatcgagctggtggcggcgctcggcttcaattgttaccgcttcggcatcgaatgggcccgcatcgagcccgttcccggccagttttcgatcgccgagttggaccactaccggcgcatgctggaggcttgccacgcgcacgggctgacgccggtggtcacgtacaaccatttcaccgcgccgcgctggtttgcagccaagggcggtttcacccagccggaggctgccggcctgttcgcccgctatgccggcaaggccacggagcacctaggtgacctgatcggcatggcgctgacgttcaacgaggccaatatccggcgcattgtcagcttgctcctgggcagtcccgaggcgctccagctgatcgacgcgatgtttgccgagtgcgcgcgcctcagcggatccgaccggttctggtcgatggtcttttcgccttacggtgaggccgagccaataatggtggacgcccatgccaaggccagcgcggcgatcaaggccggccccggggactttcccgtcgggctcacgctgtcgatgcaggacgtgcaaggcatcggcgagggcaaccaggccgaggctttgatccaggcactttacggcccatggctcgaggtagcggccgcgtccgatttcgttggcgtgcagacctacacccggatacgcgtgggaccggaaggccgtatcccgcccgacgagggtgccgaacggaccgatacgggcttcgagttctacccggcggcgttgggcggcgcgatccgatttgcgcacgagcgcatcggacgccccatctacgtgaccgagaacggcgtggccgcgaatgacgacagccggcgcattgtctacatagacggcgcattgaaagcgatgaaggactgcatcgacgagggcctggacgtacgtggctacatgcactggtcgctgttggacaacttcgaatggttcgaaggctatgccaagagatacggcctggtggaggttgatcgcgaaaccttcgagcgccgtccgaagccaagcgcccggcacctgggtgcgattgcccgctcgggcctctaa

SEQ ID NO: 622 - protein, 430 aa, Unknown
  Obtained from environmental sample
  SIGNAL (1)...(23)
  DOMAIN (26)...(430): Glycosyl hydrolase family 1
MLTRRELIAATALGLAASTKLVAAATSKTRDDFLWGVATAPHQIEGNNLNADLWLAEQVKPTIFHEPSGDACDSYHRYEEDIELVAALGFNCYRFGIEWARIEPVPGQFSIAELDHYRRMLEACHAHGLTPVVTYNHFTAPRWFAAKGGFTQPEAAGLFARYAGKATEHLGDLIGMALTFNEANIRRIVSLLLGSPEALQLIDAMFAECARLSGSDRFWSMVFSPYGEAEPIMVDAHAKASAAIKAGPGDFPVGLTLSMQDVQGIGEGNQAEALIQALYGPWLEVAAASDFVGVQTYTRIRVGPEGRIPPDEGAERTDTGFEFYPAALGGAIRFAHERIGRPIYVTENGVAANDDSRRIVYIDGALKAMKDCIDEGLDVRGYMHWSLLDNFEWFEGYAKRYGLVEVDRETFERRPKPSARHLGAIARSGL

SEQ ID NO: 623 - DNA, 1017 bp, Unknown
  Obtained from environmental sample
atgaaggaaacaacgcttagaaaaagcgaggtaataaaagtttttcgaacggaaggtagacaacaaaatgtgagcctaatgctaaaaactttaataaggaaaaaacagttgccctcaattgggccgttcaaccgtatctgctgccgaaaaccgatgaagctttccctacccctcctcatgctcctcccggcattgctggcaggctgctcgccgctgcgggcgttcaacagcctggtgcccaaggacggcggcgtggagcaggcggagcgcggcgccgccttcggaccccacgaacgccagcggctggacgtctatcgccctgcgcgggccggtgcagcgccactccccatcatcgtgttcatctacggcgggtcatggcaaaccgggacgcgcgaaggctacggctttgccgcccgggcgctggcggcgcgcggtttcgtcgtggcggtgccggactatcggctggtgccggaagtgcgctttcccgcctttctcgaagacggcgcggcggcggtgcgctgggtgcgcgccaatgcagagcgcctcggcgccgatccgtcgcgcatcgtcatcgtcggccattcggcgggcgcctacaacgccgccatgctcgcgcttgatccgcgctggctcggcgcggacagggcgtcgatcaagggtctggtggggcttgccgggccctatgacttcctgccgctcagcggtccggtcaccacggccgctttcggcgaggcgcgggtcccggccgaaacgcagccgatcaatttcgcctcggccggcgacccgcccgcgctgctgctccacggcggggcggacaccaccgtctacccgcgcaacagccagcggctggcggagcgcctgcgcgcctccgctgtagatgcgcgggtgaaggtctacccggagctcggccatgtcggcatcgttctcgccctcagccgcccattgcgcggccgtgctccggtgttggacgacatcgcagccttcgctagcgaagtgacggcagcgcgcccccgctaa

SEQ ID NO: 624 - protein, 338 aa, Unknown
  Obtained from environmental sample
  SIGNAL (1)...(74)
MKETTLRKSEVIKVFRTEGRQQNVSLMLKTLIRKKQLPSIGPFNRICCRKPMKLSLPLLMLLPALLAGCSPLRAFNSLVPKDGGVEQAERGAAFGPHERQRLDVYRPARAGAAPLPIIVFIYGGSWQTGTREGYGFAARALAARGFVVAVPDYRLVPEVRFPAFLEDGAAAVRWVRANAERLGADPSRIVIVGHSAGAYNAAMLALDPRWLGADRASIKGLVGLAGPYDFLPLSGPVTTAAFGEARVPAETQPINFASAGDPPALLLHGGADTTVYPRNSQRLAERLRASAVDARVKVYPELGHVGIVLALSRPLRGRAPVLDDIAAFASEVTAARPR

SEQ ID NO: 625 - DNA, 957 bp, Unknown
  Obtained from environmental sample
atgaaatgtgatgcagtatttgaaggtggcggtgtcaaaggtattgccttcgtcggagctgttcaggaagcggaaaagcagggctatgtgtttgaacgggtagccgggacatcggcagggtctattgttgctgcacttattgcagccggatattccggagacgagttggaaacacatatgaaagagctttcatttgcatcttttcttgatttaaacagtttggggcgtattcctttcgtcggcaaaagtttaaacatcatgttcagaaacggcgtttattcaggcaagcgactcgaagcgtgggttgatgctaaactgaagcgaaaagggatacgttttttcggagatttaccggataataaactgaccgttattgcctcagatattacgaacgggcgtattatgcgcataccggatgatctgcaggaatacgggctggacgtcagtacatttcctgttgccaaagcagtgctcatgagttgtacgattccatatttttttcagcctgttattttaaaatataacggtaagaaagcgtacattgtggatggtggcctgcttagtaattttccggtttggctgtttgatacgacaaatacgacgccccgctggccaacgttcggatttcggttacgaggggcagacagcgaagacccggcacacattgcaggacccgttacgatgtttcgggctattgtatcgacgatgctggaagcacatgaccggcgctatataaagaaaaaagatgcccaacggacgatatttatcccggttgataatattaaagcaacggattttgatattagtaaagaagagcaacggcaactgattgaattaggcagagcagaagctgaggaattttttgatcagtggaatttttcaagacatattcatcagttccgtcgcatgccgaaatttattcagacaagaacgcaggcagcaaaaaatgaaggctga

SEQ ID NO: 626 - protein, 318 aa, Unknown
  Obtained from environmental sample
  DOMAIN (5)...(196): Patatin-like phospholipase
MKCDAVFEGGGVKGIAFVGAVQEAEKQGYVFERVAGTSAGSIVAALIAAGYSGDELETHMKELSFASFLDLNSLGRIPFVGKSLNIMFRNGVYSGKRLEAWVDAKLKRKGIRFFGDLPDNKLTVIASDITNGRIMRIPDDLQEYGLDVSTFPVAKAVLMSCTIPYFFQPVILKYNGKKAYIVDGGLLSNFPVWLFDTTNTTPRWPTFGFRLRGADSEDPAHIAGPVTMFRAIVSTMLEAHDRRYIKKKDAQRTIFIPVDNIKATDFDISKEEQRQLIELGRAEAEEFFDQWNFSRHIHQFRRMPKFIQTRTQAAKNEG

SEQ ID NO: 627 - DNA, 1434 bp, Unknown
  Obtained from environmental sample
atgaaaaagaaaatatgtacattggctcttgtatcagcaataacttctggagttgtgacgattccaacggtagcatctgcttgcagaataggcgaagaagtaatgaaacaggagaaacaggataatcaagagcacaaacgtgtgaaaagatggtctgcggagcatccgcatcattctaatgaaagcacgcacttatggattgctcgaaatgcgattcaaattatgagtcgtaatcaagataacacggtccaaaacaatgaattacagttcttaaatattcctgaatataaggagttatttgaaagaggactttatgatgctgattaccttgatgaatttaacgatggcggtacaggtacaatcggcattgatgggctaattaaaggagggtggaaatctcatttttatgatccagatacgaaaaagaattataaaggagaagaagctccaacagcccttacgcaaggagataaatattttaaattagcaggagactattttaagaaagaggatttgaaacaagctttctactatttaggtgttgcgactcactatttcacagatgctactcagccaatgcatgctgctaattttacagctgtcgacatgagtgcgataaagtttcatagcgcttttgaaaattatgtaacgacaattcagacgccatttgaagtgaaggatgataaaggaacctataatttggttgattctaatgatccgaagcagtggatacatgaaacagcgaaactcgcaaaagcggaaattatgaatattactaatgatactattaaatctcaatataataaagggaacaatgatctttggcaacaaggagttatgccagctgttcagagaagtctggaaacagcacaaaggaacacggcaggatttattcatttatggtttaaaacatatgttggcaaaactgctgctgaagatattgaaaatacacaagtaaaagattctaacggagaagcaatacaagaaaataaaaaatactacgttgtaccgagtgagtttttaaatagaggtttgacctttgaggtatatgctgcaaatgactacgcactattagctaatcacgtagatgataataaagttcatggtacacctgttcagtttgtttttgataaagacaataacggaattcttcatcggggagaaagtgcactgatgaaaatgacgcaatctaactatgctgattatgtatttctcaattactctaatatgacaaattgggtacatcttgcgaaacgaaaaacaaatacttcacagtttaaagtgtatccaaatccggataactcatctgaatatttcttatatacagatggatacccggtaaattatcaagaaaatggtaacggaaagagctggattgtgttaggaaagaaaacggataaaccaaaagcgtggaaatttatacaggcggaataa

SEQ ID NO: 628 - protein, 477 aa, Unknown
  Obtained from environmental sample
  SIGNAL (1)...(27)
  DOMAIN (1)...(307): Zinc dependent phospholipase C
MKKKICTLALVSAITSGVVTIPTVASACRIGEEVMKQEKQDNQEHKRVKRWSAEHPHHSNESTHLWIARNAIQIMSRNQDNTVQNNELQFLNIPEYKELFERGLYDADYLDEFNDGGTGTIGIDGLIKGGWKSHFYDPDTKKNYKGEEAPTALTQGDKYFKLAGDYFKKEDLKQAFYYLGVATHYFTDATQPMHAANFTAVDMSAIKFHSAFENYVTTIQTPFEVKDDKGTYNLVDSNDPKQWIHETAKLAKAEIMNITNDTIKSQYNKGNNDLWQQGVMPAVQRSLETAQRNTAGFIHLWFKTYVGKTAAEDIENTQVKDSNGEAIQENKKYYVVPSEFLNRGLTFEVYAANDYALLANHVDDNKVHGTPVQFVFDKDNNGILHRGESALMKMTQSNYADYVFLNYSNMTNWVHLAKRKTNTSQFKVYPNPDNSSEYFLYTDGYPVNYQENGNGKSWIVLGKKTDKPKAWKFIQAE

SEQ ID NO: 629 - DNA, 1281 bp, Unknown
  Obtained from environmental sample
atgaacacgactcgtgccctcaggcatgcggctgccgcatgcgcgttcctgtccctcggctccgcggcgctgcccgcgctggccgccaacaacgctcccgtcatcctcgtccacggtttcgccggcttcggccgcagcgagctgctgggctacaagtactggggcggcctcaacgacctgcaggagcagctgaaggcccagtacgcggaccaggcggtggccaccgcggtggtcggcccgttcagctcgaactgggatcgcgccgtcgaactgttctaccagatcaagggcggctgcgtggactacggcgcgctgcatgcggcggccaacggccacctcgagagccccgagagctactttcacaatggccgcacctgctaccccgggctgtatccggcctgggacggcagccatcccgtgcacctgatctcgcacagcatgggcggccagacctcgcgcatgctggtgcagatgctcgcggccaacggcgcgccggccaatccgtcgctgttcccttacgccgtcgacgcgagctgggtcaagagcgtgacgacgatcgccacgcccaacgacggcaccacgctggcgtaccgcatcacggactgggtgccgttcgtgcagcagctcgtcaccggcatcgccaacttcacgggcgcgaccggcggcaacctggtctacgacttcaagctcgaccagtggggtgtgggcgcgcaggcgccgggcgagagcttcaccgcgtacgtgaaccgcgtcacgggcagcccgctgtggaattccggcgtgaaggacctgtcgccgtacgacctctcgcctgctggcgcgatggccgagaacgactgggtcaaggaccagcccaacgtcacctacttctcttgggtgacgaactcgagctacagcgggctgctcaccggctggtcgtaccccgacctcgacaccaatccgttgatcgcggcgttcgccggccccggcttcatgggcaactactaccgcgattcgcgcccgatgccgccggtcgacgacagcacctggttccccagcgacgccgtcgtcaacacgatcgcgcaggaggtgcccacctgggcgatgaacgcggcgggcacggtctacaagcgcccggtggtgctgcgcgacatcagcaacggcggcgcgccgcaggccggcgcgtggaactacaagggccggctcgacggcttcgaccacctcgacgcagtgggctggacgctgttctgggacagcctgtcctggtacaaggcgcgcgtcgacgagctgcgcgcgctctga

SEQ ID NO: 630 - protein, 426 aa, Unknown
  Obtained from environmental sample
  SIGNAL (1)...(28)
MNTTRALRHAAAACAFLSLGSAALPALAANNAPVILVHGFAGFGRSELLGYKYWGGLNDLQEQLKAQYADQAVATAVVGPFSSNWDRAVELFYQIKGGCVDYGALHAAANGHLESPESYFHNGRTCYPGLYPAWDGSHPVHLISHSMGGQTSRMLVQMLAANGAPANPSLFPYAVDASWVKSVTTIATPNDGTTLAYRITDWVPFVQQLVTGIANFTGATGGNLVYDFKLDQWGVGAQAPGESFTAYVNRVTGSPLWNSGVKDLSPYDLSPAGAMAENDWVKDQPNVTYFSWVTNSSYSGLLTGWSYPDLDTNPLIAAFAGPGFMGNYYRDSRPMPPVDDSTWFPSDAVVNTIAQEVPTWAMNAAGTVYKRPVVLRDISNGGAPQAGAWNYKGRLDGFDHLDAVGWTLFWDSLSWYKARVDELRAL

SEQ ID NO: 631 - DNA, 633 bp, Unknown
  Obtained from environmental sample
atgaacatcagattgacttctgttttagccctgtcgctgactctgttgctgggacaggtcagcggaaaggaccgggaaacgaagacgatccttgttctgggcgacagtctggcggcaggctacggcgtttcgcctgaacaggcttttccgggccttctgcaggaaaagctgcgtcagcgaggacttgccttcagggtcatcaacgctggaatcagcggagatacttcatcgtccggtttgagccggatcgaatggtatttgcgcgatccgatcgacatcctcattctggaactcggagcaaatgacggattgcgcggaatctctccggaagccaccgagtccaatctggctgaaacgatcaaacgtttccgcacggcgaacccttccggagaagcgatcctcgccgggatgctggtgcctccaaacatgggcccgcaatactctcgccagtttcaagaaatatttccccgcctggccgaaaggacgggcgctcgtttgatccccttcctgctggagggagtggcgggagatccccggttaaatctgcctgacgggattcatccgactcctgagggccatcggatcgttgccgaaaatgtctggagggttctcgaaccgatccttcaggaatga

SEQ ID NO: 632 - protein, 210 aa, Unknown
  Obtained from environmental sample
  SIGNAL (1)...(22)
  DOMAIN (30)...(200): GDSL-like Lipase/Acylhydrolase
MNIRLTSVLALSLTLLLGQVSGKDRETKTILVLGDSLAAGYGVSPEQAFPGLLQEKLRQRGLAFRVINAGISGDTSSSGLSRIEWYLRDPIDILILELGANDGLRGISPEATESNLAETIKRFRTANPSGEAILAGMLVPPNMGPQYSRQFQEIFPRLAERTGARLIPFLLEGVAGDPRLNLPDGIHPTPEGHRIVAENVWRVLEPILQE

SEQ ID NO: 633 - DNA, 729 bp, Unknown
  Obtained from environmental sample
atgagttcagctgtttctgatattgcctccctgaaagcccggctgaaggtcacctggaggactggtgacttcggccaaatcgccaagtcctatgagtccggtgctgcagagtttatcgaacgacttaatctcaagtccggtacgcggctactcgatgtagcatgcggtacgggtaatttagctctcccggcagcccgcgctggcgccatcgtgagcggtgttgacctagctgacaacttgctcgagcaagcccgctcacgcgccgaggctgaagggcttaaagcaaagtttgatgaaggcgatgccgagcagttgccttacgaagatgcgagctttgacgttgttgtcagcatgtttggatctatgttcgccccgcgccccgaactggtttccatcgagttacttcgcgtctgccgtcctggtgggagaatagctttggctaactggacctccgcagggttcatcggccaaatgttcaaaacgatctcgacgcatgtgccgccgccacctaacatgccatcgccgctgaagtggggagacgaggtgaccgtgcgcgagaggttgggcggcggtgtttccgacataagtatgacccgccgattgatgccatttaccttcccattcgggccaaaagaggttgtagagttctttcgcgtttactatggaccgacaaacaaagcattcgaggcagttgctgctgacccgaacaagcaggcagcaatgcgcgta

SEQ ID NO: 634 - protein, 243 aa, Unknown
  Obtained from environmental sample
  DOMAIN (12)...(200): ubiE/COQ5 methyltransferase family
MSSAVSDIASLKARLKVTWRTGDFGQIAKSYESGAAEFIERLNLKSGTRLLDVACGTGNLALPAARAGAIVSGVDLADNLLEQARSRAEAEGLKAKFDEGDAEQLPYEDASFDVVVSMFGSMFAPRPELVSIELLRVCRPGGRIALANWTSAGFIGQMFKTISTHVPPPPNMPSPLKWGDEVTVRERLGGGVSDISMTRRLMPFTFPFGPKEVVEFFRVYYGPTNKAFEAVAADPNKQAAMRV

SEQ ID NO: 635 - DNA, 747 bp, Unknown
  Obtained from environmental sample
atgaaggttaaccttgtgctttcgggcggggcttctcggggcatagcccatattggtgtgataaaggctttggaagagcttggctttgagataagagccataagcggggtaagtgccggcgcccttgtgggagctttctactgcgatggctacacaccagaggagatgctaagggttgtaaaatcaaaggagtggctaaagtatttgaggccagccattccaaggcttggctttatatctttaaaagaggcggaaaagtacttgaataagatgctatccataaggcgcattgaagaggcaaagaaaaagctattcattggggccttggacataaagagtggaaagaccttctactttgatagtggagaccttgtgcctatacttttgggtagctgcgccctgccgggcatctttgaacctataaggtataaggaatatcttcttatagatggtggtattaccaacaaccttcctgcagagcctttgctttccatggatggcatgcttgtaggcgtggatgtaaacccaagcgaacaggtggagaagataaggaatatatttcacctacttgtgagaagttttctcttggcggtgaggtctaacgtggataagaggaaagagctttgccatgtggtaatagagccagacctttttaaatactcacccctcagccttctaaaggctgatgaaatatataggcttggctatgaaaaaaccatgcaggtgctaaggccatatgtccaataa

SEQ ID NO: 636 - protein, 248 aa, Unknown
  Obtained from environmental sample
  DOMAIN (5)...(163): Patatin-like phospholipase
MKVNLVLSGGASRGIAHIGVIKALEELGFEIRAISGVSAGALVGAFYCDGYTPEEMLRVVKSKEWLKYLRPAIPRLGFISLKEAEKYLNKMLSIRRIEEAKKKLFIGALDIKSGKTFYFDSGDLVPILLGSCALPGIFEPIRYKEYLLIDGGITNNLPAEPLLSMDGMLVGVDVNPSEQVEKIRNIFHLLVRSFLLAVRSNVDKRKELCHVVIEPDLFKYSPLSLLKADEIYRLGYEKTMQVLRPYVQ

SEQ ID NO: 637 - DNA, 915 bp, Unknown; identical to SEQ ID NO: 113
  Obtained from environmental sample

SEQ ID NO: 638 - protein, 304 aa, Unknown; identical to SEQ ID NO: 114
  Obtained from environmental sample
  SIGNAL (1)...(25)
  DOMAIN (44)...(280): alpha/beta hydrolase fold

SEQ ID NO: 639 - DNA, 1422 bp, Unknown
  Obtained from environmental sample
atgatcgttctattcgttcacggatggagtgttcaacacaccgacagctacggcgaactgccggcctggctggcccgccaaaacgggcccgacggccagccgcttacgattgaagatgtgttcctcggcaagtacgtcagcttcgatgacaccgtgagcgtcgatgacattgcgcgcgcgctggatttcgccgtccgcgacaagctgggaagccggctcaagaagggggaacgcttcgccgccatcacgcattccaccggcgggcccgtggtgcgggcctggatggacctgtattggaagaagaagctcgaccgttgcccgctcagtcacctcatcatgctggctcccgccaaccatggctcggccttggcccagttgggcaagggccgtctcagtcgcatcaagaccttcttccagggagcggaacccggccagcgcgtgctcgattggctggagcttggcagtgaaggttcatgggccctcaataccagctggctggattatgactgcgttcccgctggcgtatttcccttcgtgctcaccggtcaacgcattgatcgcaagctctacgatgccctgaactcctatacgggcgagccgggctcggacggtgtcgtgcgcgtcgccgccgcgaatatcaactacggcttgctgcgtctggtgcaggacgagacggacctcaaagtcgaacgactccgccgcacggctcggaccgcttggggcgtcttgcccggcctttcccattccggcgacgagatggggatcattcgcagcgtgacgctggagaacgccgaaactcatccgacggcccaatgggtgctgcgctgtctcggcgtcagcagcatggcctcgtacaatcggctgatggccgagctggacgcactcactgcgaagacgcaagaggaagaacacgaagaaaaggtgcgcagcttgttcaaacggcggacgtatcccaacccgcgtcatggcatgattgtcttccgcctggtggacgatcgtggcgaatacctctccgactacgacctctacttcaccgccggtcccgactacgacgaagacgagttgccggaagggtttttccaggatcgtcagcgtaaccaacgcaatcggggcaagctgacctactatctgaattatgacgtgctcgagtctggtttggaatccaagggactggaaggcaagttcgggttcaaggtcaccgcgaggcccgatgaggaacccggcaagcgtaaactggccttctatcgcacgctcaacttcgaaggcaccgcccagcaggtgaagaaattcctgctgcccaacgaaaccctgatggtcgaaatccagctccagcgccaggtggacgccgccgtgttccaggtcgagaaggaactcgccccgagcccgatcgacgccacgcccacgggccggctggtggattga

SEQ ID NO: 640 - protein, 473 aa, Unknown
  Obtained from environmental sample
MIVLFVHGWSVQHTDSYGELPAWLARQNGPDGQPLTIEDVFLGKYVSFDDTVSVDDIARALDFAVRDKLGSRLKKGERFAAITHSTGGPVVRAWMDLYWKKKLDRCPLSHLIMLAPANHGSALAQLGKGRLSRIKTFFQGAEPGQRVLDWLELGSEGSWALNTSWLDYDCVPAGVFPFVLTGQRIDRKLYDALNSYTGEPGSDGVVRVAAANINYGLLRLVQDETDLKVERLRRTARTAWGVLPGLSHSGDEMGIIRSVTLENAETHPTAQWVLRCLGVSSMASYNRLMAELDALTAKTQEEEHEEKVRSLFKRRTYPNPRHGMIVFRLVDDRGEYLSDYDLYFTAGPDYDEDELPEGFFQDRQRNQRNRGKLTYYLNYDVLESGLESKGLEGKFGFKVTARPDEEPGKRKLAFYRTLNFEGTAQQVKKFLLPNETLMVEIQLQRQVDAAVFQVEKELAPSPIDATPTGRLVD

SEQ ID NO: 641 - DNA, 1932 bp, Unknown
  Obtained from environmental sample
atgcgcaggctctccctactcatccccttggcgggatgcatcctgtccatcgtcagtgaacgtgccatagcagcaccctcgccgtattccaccatgatcgtgttcggcgacagcctgagcgactcggggcattttccaggggtcggcacaggcatgcgcttcaccaaccgcaccgggccgacgtacagggattaccggggggaggaatatgctgcagtaacgcccacgcggctgggcacccaactggggatcgccccggcagacctgcgcccgtccacttcgccgggcaactctcttgcaggggagcccgacggcaacaactgggcggttggcggctatcgcacagaccagattctcaattccatcaagaccgagtcaaaggtcgccatcccggatgactggtccttcgtcggcggctacgtcctgcgcagcaagcctggttaccttgtgcagaacagcttcacggctgaccccaaggcgttgtatttcatttcaggcggcggtaatgactttctccaaggcaaggtcaccaaccccgccgaggcaggccaagccgcacaaaggctggcggcaagcgcccacaccctgcaacaggcaggggcacgctacatcatggtctggctgctgcccgatctgggcctgacgccagccgtttacggtacacccacccaggctggcaccagcgccctgagcgccctgttcaatcatgagctaacccagcaactggcgcagatagacgccgaagtgattcccctcaatatcccgctgctgctgcgtgaagccatcgccgaccccgcccgttatggcctggcactggggcaggaccttgtcgcgacctgtttcaatggcgaagagtgtacggaaaacccgcagtacggcctcaacagcgcaactcccaacccggccaaactgctgttcaacgactcggtacaccccaccgagacagggcaacagctgattgccgactatgcctactcattgctggccgtgccgtgggagctgaccttgttacccgttatggcccaaggctcgctaaacgcccatcaagaccagttgcgcaaccaatgggctggcgacgacggtcaatggcaagccataggccagtggcgaaccctgctcgccggtggcggtcaacgcctggaaatcgacaagcagaccacggccgtgaaggcagatggcaaaggctataacctcaatatcggcaccagctacaggctggatgacaactggcgatttggcattgccggcgggttttaccggcaacgcctggaaaccggggccaataaatcggactacaagctcagcagctatctgggtagcgtgtttgcccaataccagcacaatcactggtggggggatgcggcactgacgttgggcaggctggattacgacagcctgaagcgaaaattcgcgcttggggtgggtagtgagatggagcaaggccaggctgacggccatttgcgagcattgagtacacgcctgggttatgaaatcgcacaggcatctgacctgtggcagctctccccctttatcagcgccgattactcgcgggtggaagttaaccgctatgaagaaaagggccggcgctccactgcattgaactacgaagagcagacacttgtttcaaatcgcctgggcgcgggtttgctcgccagttaccaggccaccccacaaacgctgttatttggcgaggccgcccatgaacatgagttccagagcgatacccagcgcctgaacatcgcactcaacagcctgcccgacaaccgcttcaagctcgagggctatacaccgccgagcaaccttgcccgtgtaagcctgggggtcagccacagattgactgccgatcttgtgctgcgggcggcttataacgcgagaaagagtgatggggtaacgcaacagggcgccactatcggggtgagcctgaacttctga

SEQ ID NO: 642 - protein, 643 aa, Unknown
  Obtained from environmental sample
  SIGNAL (1)...(24)
  DOMAIN (346)...(643): Autotransporter beta-domain
  DOMAIN (32)...(324): GDSL-like Lipase/Acylhydrolase
MRRLSLLIPLAGCILSIVSERAIAAPSPYSTMIVFGDSLSDSGHFPGVGTGMRFTNRTGPTYRDYRGEEYAAVTPTRLGTQLGIAPADLRPSTSPGNSLAGEPDGNNWAVGGYRTDQILNSIKTESKVAIPDDWSFVGGYVLRSKPGYLVQNSFTADPKALYFISGGGNDFLQGKVTNPAEAGQAAQRLAASAHTLQQAGARYIMVWLLPDLGLTPAVYGTPTQAGTSALSALFNHELTQQLAQIDAEVIPLNIPLLLREAIADPARYGLALGQDLVATCFNGEECTENPQYGLNSATPNPAKLLFNDSVHPTETGQQLIADYAYSLLAVPWELTLLPVMAQGSLNAHQDQLRNQWAGDDGQWQAIGQWRTLLAGGGQRLEIDKQTTAVKADGKGYNLNIGTSYRLDDNWRFGIAGGFYRQRLETGANKSDYKLSSYLGSVFAQYQHNHWWGDAALTLGRLDYDSLKRKFALGVGSEMEQGQADGHLRALSTRLGYEIAQASDLWQLSPFISADYSRVEVNRYEEKGRRSTALNYEEQTLVSNRLGAGLLASYQATPQTLLFGEAAHEHEFQSDTQRLNIALNSLPDNRFKLEGYTPPSNLARVSLGVSHRLTADLVLRAAYNARKSDGVTQQGATIGVSLNF

SEQ ID NO: 643 - DNA, 558 bp, Unknown
  Obtained from environmental sample
atgaaacgcagaaccttcctgaagagaatcgttgcctctctcctggtggcgctgatgatctgcggcagtaccgttgcctacgcttcagccgctgacaaccacacctataccaccgctcccgaaatctaccagttgatccgcgacggctacaaccagggtgagaaaggccccatctccatcgtcaagggcactctgaaatccggctggagttcaaagaccgtctaccttgtcaccctgtccggtaccgagatcgtgttcaaccagaccaccgaaggcctgaccgatctgctgtccggtttcaatctgaaaaacccctactataccaacgtggtcaatgtaatcaaaaacaacgtgcccaagaacgccaatcttgtactggccgggcacagtctgggcggcatgattgcccagcaggtggctgccgattccaccatcaagtcccgctacaatgtcctcaataccgtttgcttcggctctccgctgctggctgccggtttccgggaaggcaccgttcgccggctgggtgacgtctccgatccggtcccctatctgtcctga

SEQ ID NO: 644 - protein, 185 aa, Unknown
  Obtained from environmental sample
  SIGNAL (1)...(28)
MKRRTFLKRIVASLLVALMICGSTVAYASAADNHTYTTAPEIYQLIRDGYNQGEKGPISIVKGTLKSGWSSKTVYLVTLSGTEIVFNQTTEGLTDLLSGFNLKNPYYTNVVNVIKNNVPKNANLVLAGHSLGGMIAQQVAADSTIKSRYNVLNTVCFGSPLLAAGFREGTVRRLGDVSDPVPYLS

SEQ ID NO: 645 - DNA, 825 bp, Unknown
  Obtained from environmental sample
atgaaaaaggaaacgatcatccattcctttgatggaactgaactgtatatgcaaaaaaatacgcctcaaaatccgcatgcggtaatggttattgtccatggacttggcgagcactcgggccggtatgagtatgtaacagaaaaattgaacggatatggctatgccgtctaccgttttgacaaccgcggccatgggaaatccggcggtgcgcgaggctatgtggaggatgcgtctaaattcgttcatgatgcacatgaagtcgtaaaggcggctcgtcatgactatccgaaactgccgattttcatgctaggccacagtatgggcggatttattgcggcgtcttatggtgttcaatacaaaaatacattggccggccaaattttctccgggcctgtcattctggaactgccggcattcgatgagttaaaaaagctggatatggaaaaagaggcgctgacgcggattccgaacggactggctcacctgatctgccgcagcccggctgtcgtccaggattacgaaaatgacccatacaatttaaaagaattcaccgcaaaactgctgacgactgtttttcacgagggtgtacaacatttgcttcaaaagctccctcagtacacatatccttgttatattttacacggcgaggacgatcaaatcgttcctgccgattcaggaagatacttatacgatcacattgcctctgaagataaatctatttgtgtaatcccacacctctatcatgaaatactgaatgaggaaaaagaaaaagacgagcttttacaagaaatattcgaatggatagaagaacgaatacaaaaataa

SEQ ID NO: 646 - protein, 274 aa, Unknown
  Obtained from environmental sample
  DOMAIN (54)...(274): alpha/beta hydrolase fold
MKKETIIHSFDGTELYMQKNTPQNPHAVMVIVHGLGEHSGRYEYVTEKLNGYGYAVYRFDNRGHGKSGGARGYVEDASKFVHDAHEVVKAARHDYPKLPIFMLGHSMGGFIAASYGVQYKNTLAGQIFSGPVILELPAFDELKKLDMEKEALTRIPNGLAHLICRSPAVVQDYENDPYNLKEFTAKLLTTVFHEGVQHLLQKLPQYTYPCYILHGEDDQIVPADSGRYLYDHIASEDKSICVIPHLYHEILNEEKEKDELLQEIFEWIEERIQK

SEQ ID NO: 647 - DNA, 1566 bp, Unknown
  Obtained from environmental sample
atgagatttgaccgaaaaggcgcacgtctgggtagcccccttttgcttagcgcgatgattggcatggcactcgccggatgcggtggcgataatgaagatcgtaaccgtgttctgacagaccggggtgaagtgcttggtaccgaagccgcaggcatgcaccaatatctgggcattccatacgcagcgccgccgaccggtacgcgtcgctggaaagcgccagagccgcccgcaccttggagcacgacgcgcgatgccagcaagttcggtagcggctgtccgcaaaccggaggcgcctttggcacagccagtaccaacgaagactgcctgtatctgaatgtctttactcccaaaggcaatgggcccttccccgtcatggtctgggtgcacggcggtgcgttcgtatccgggtccggcgacagttacgacgcgagcaaactcgtttcgcaaggcgtcgccgtcgtcacaatcaattaccgcctcggttatttcggatttctcgcccatccttcgctcagcgcggagcaaggaggatcgtccggcaactatggcttgatggatcagcaggctgcgctgcgttgggtcaagaacaacatcgcgcagttccgcggcgatccgaataacgtaacggttttcggagaatcggccggcggactcagcgttcaatcccaagtagcttcgccactggctgccggtctgttcaacaaggcaatcgtgcagagcggcgcctatgcgcttgacctgccttcacttgcacaagcgcaggctggaggtacggcggtggccacggctgccggttgcacggaccagagtgcaagctgcctgcgcgcattgaccgttgagcagatcctgcaacgtcagaccggtgccaatgtcgtgccgactgtcgacaacagggtccttccgctgaccttgcgcgcagcgttcaccacaggcagctttaacaaggtgccggtcattgagggtaacaatgcggacgagtacagcctgctctcggccgctcgcatggatctcgtgccatcagttggtccggtgaccgcggcaaattatcaggcacgtgtcacaagcctgatcgccacctcgggcaagacgtttgaacaggtaaatgcgcaatatcctttgacagcatatgcaactccggttgaagcctatgacgcaattgcgaccgatctggtgttcgcatgctccggtcgcacctcagcaagactcaagagcgcaagcggcgtcaatgtctacgcttatgagttcaatgatccgaatgcgccgatgatctatctgccgccggcgacgcgtccgcgctggggtgcataccatgcagccgagatccagtatctgttcccgaccactcgccccaatgttacctacaccccggctcagcaatccctgtccaaccaaatggtcgcctactggaccgcatttgcgaagagcagcaatccaaacggtaccggacccacttggccccaatacaccagtgcgaacgacacctacctttcacttgaaccgggaacctcgcgcacgctgactaactttgcggaaaaacacaagtgcacgttctggtccggctcctga

SEQ ID NO: 648 - protein, 521 aa, Unknown
  Obtained from environmental sample
  SIGNAL (1)...(25)
  DOMAIN (7)...(518): Carboxylesterase
MRFDRKGARLGSPLLLSAMIGMALAGCGGDNEDRNRVLTDRGEVLGTEAAGMHQYLGIPYAAPPTGTRRWKAPEPPAPWSTTRDASKFGSGCPQTGGAFGTASTNEDCLYLNVFTPKGNGPFPVMVWVHGGAFVSGSGDSYDASKLVSQGVAVVTINYRLGYFGFLAHPSLSAEQGGSSGNYGLMDQQAALRWVKNNIAQFRGDPNNVTVFGESAGGLSVQSQVASPLAAGLFNKAIVQSGAYALDLPSLAQAQAGGTAVATAAGCTDQSASCLRALTVEQILQRQTGANVVPTVDNRVLPLTLRAAFTTGSFNKVPVIEGNNADEYSLLSAARMDLVPSVGPVTAANYQARVTSLIATSGKTFEQVNAQYPLTAYATPVEAYDAIATDLVFACSGRTSARLKSASGVNVYAYEFNDPNAPMIYLPPATRPRWGAYHAAEIQYLFPTTRPNVTYTPAQQSLSNQMVAYWTAFAKSSNPNGTGPTWPQYTSANDTYLSLEPGTSRTLTNFAEKHKCTFWSGS

SEQ ID NO: 649 - DNA, 1272 bp, Unknown
  Obtained from environmental sample
atgaacgcacaccgtgccctcctgtccgcctgcgcggccttcaccctcgcgaccccggcgctgcccgtgctggccgccaacacctacccggtcatcctcgtccacggcttcgccggcttcggccgcagcgagctgctgggctacaagtactggggcgggctgaccgacctgcaggagcagttgaagacgaagtactcgaaccagctcgtggccaccgcggtggtcgggccattcagctccaactgggatcgcgccgccgaactgttctaccagatcaagggcggctgcgtggactacggcgcgctgcacgccgcggccaacgaccacctcgaacgccccgagagctatttccacaacggccgcacctgctaccccgggctgtatccggcctgggacgccaaccaccccgtgcacctgatcacgcacagcatgggcggacagacgtcccgcatgctggtgcagatgctcgccgccaacggcgcgccggccaacccgtcgctgttcccgtacgcggtcgacgcgaactggatcaagagcgtgacgaccatcgcgacgcccaacgacggcaccacgctcgcttaccgcatcgtcgactgggtgcccttcgtgcagcagctggtgacgggcatcgccggcatcgcgggcgcgaccggcgcgaacgcgatctacgacttcaagctcgatcaatggggcgtcggcccgcaggccgctggcgagagcttcagcgcctacgtcaaccgcgtgacgagcatcccgctgtggaactccggcgtgaaggacctgtctccctacgatctctcgcccgccggcgcgatggccgagaacgactgggtcaaggacgcgcccggcgtcacctatttctcgtgggtgacgaactccagctacagcggctggctcaccggctggtcgtatcccgacctcgacaccaacccgctgatcggcgcgttcgcgggcccgggcttcatgggcaactacagccgcgactggcgcccgatgccgcctgtggccgacagcgactggtaccccagcgacgcggtcgtcaacaccatcgcgcagaaggcgcctacgtgggcgatgaatgcggcgggcgtggtctacaagcgatccgtcgtcgtccgcgacatcagcaacggcggcacgccgcaggccggcgcatggaactacaagggcacgctgagcggcttcgaccacctcgacgcggtgggctggacgttgttctgggacagcctgtcctggtacaaggcgcgcgtcgacgagttgcgcgcgctgtag

SEQ ID NO: 650 - protein, 423 aa, Unknown
  Obtained from environmental sample
  SIGNAL (1)...(25)
MNAHRALLSACAAFTLATPALPVLAANTYPVILVHGFAGFGRSELLGYKYWGGLTDLQEQLKTKYSNQLVATAVVGPFSSNWDRAAELFYQIKGGCVDYGALHAAANDHLERPESYFHNGRTCYPGLYPAWDANHPVHLITHSMGGQTSRMLVQMLAANGAPANPSLFPYAVDANWIKSVTTIATPNDGTTLAYRIVDWVPFVQQLVTGIAGIAGATGANAIYDFKLDQWGVGPQAAGESFSAYVNRVTSIPLWNSGVKDLSPYDLSPAGAMAENDWVKDAPGVTYFSWVTNSSYSGWLTGWSYPDLDTNPLIGAFAGPGFMGNYSRDWRPMPPVADSDWYPSDAVVNTIAQKAPTWAMNAAGVVYKRSVVVRDISNGGTPQAGAWNYKGTLSGFDHLDAVGWTLFWDSLSWYKARVDELRAL

SEQ ID NO: 651 - DNA, 879 bp, Unknown
  Obtained from environmental sample
atgaaaatcatctctctgttatttataggtataatgacagtgaccgccccggcagacagctccgctgaaaacagcagcagcattcatcccggaaaaatggaaaacatatggccagcaggagtcaatcccgacggttggaaacaggaaaagcctgaagtatcagaattcaggaacggtgttacaaggatctcaaatgtcaatacgcccactctgacatattttccgcccgctccgggatccgacaaaaaaaacaaagctgtgatcatctgccccggagggggatatcacatcctggcaattgacaaggaaggatatgatgtcgcggattttctaagcaggcacggctttcacacctatgttctgaaataccgactgcctagaaaaggtgctgataagaaacgctggctgccggcactgcaggatgcccagcgcgcactaagcattatagcttccagaaaaaaagaactcggaattgaagaagtcggaattatgggattctcagccggaggacacctttcagcacttaccgcgtgcagacatgaaaacaggtcatataaaccggttgatgctgcggacaaagcttcatgccgtcctgacttcgccgttctgatatatccggcctatctggtaaccccccggacacataaactttcacctgaactttccgtccgtaaggggatgcccaggaccttcctggttcagactgaagacgactgtattcatgttgaaaattctcttttcttctactacgcacttaaacagaagaatattcctgcggaaatgcatatctttgctgaaggaggccacggatatgccctgtgttctgataaaccggtaaaaatctggcctgaacttctcctgaaatggctttctgaataa

SEQ ID NO: 652 - protein, 292 aa, Unknown
  Obtained from environmental sample
MKIISLLFIGIMTVTAPADSSAENSSSIHPGKMENIWPAGVNPDGWKQEKPEVSEFRNGVTRISNVNTPTLTYFPPAPGSDKKNKAVIICPGGGYHILAIDKEGYDVADFLSRHGFHTYVLKYRLPRKGADKKRWLPALQDAQRALSIIASRKKELGIEEVGIMGFSAGGHLSALTACRHENRSYKPVDAADKASCRPDFAVLIYPAYLVTPRTHKLSPELSVRKGMPRTFLVQTEDDCIHVENSLFFYYALKQKNIPAEMHIFAEGGHGYALCSDKPVKIWPELLLKWLSE

SEQ ID NO: 653 - DNA, 807 bp, Unknown
  Obtained from environmental sample
atgcgcataggactggcactttcgggtggtggagcacgaggactcgtacatgttggcgtgctcgaggcattgcgcgaagcgggcatacccattttcgcggtatcaggaacgagtgccggagcgatcgtcggatcgctgtatgccgcaggttatacgcccggagagatcatggcatttgccagggagagaagcctgatccatgtattgaatctgacgctgcccacacgcggctttgtcaggcataagtttctcaggaaactattgcgcaaacgcctgccggatgaaggcaggagtttcgatgggttgaaactccctctgtatatcacggttgcaaacctcaattccggtcttgccgagacgttttcgtcgggtccgctcctggaccttgtgatcgcatcgagttccgtgccgatcctcttcgagcccgtgcgaatcaatggcagcctgtacagcgatggcggactcatcatgaacctgccggcatcaccgctcctgccgcattgcgacttcatcattgcagtcaacctcgtcccgcaactgccggttgacgacagcgaactcaagacgctcgtcggtatcggtacacggtgctttgatctggcagcattgaacaatatcaagccggagctcgcatattgtgatgtggtcatcgagccgccggagataagccgtttcagccgcttcagtgtgtcaaacgttcagcgtatgttcgacataggctatgaagagacccaaaaacacctcgcgtacatcgctgatcatatagaccggcgggaggatgacacagtacgtgctgcagcgaaataa

SEQ ID NO: 654 - protein, 268 aa, Unknown
  Obtained from environmental sample
  DOMAIN (5)...(165): Patatin-like phospholipase
MRIGLALSGGGARGLVHVGVLEALREAGIPIFAVSGTSAGAIVGSLYAAGYTPGEIMAFARERSLIHVLNLTLPTRGFVRHKFLRKLLRKRLPDEGRSFDGLKLPLYITVANLNSGLAETFSSGPLLDLVIASSSVPILFEPVRINGSLYSDGGLIMNLPASPLLPHCDFIIAVNLVPQLPVDDSELKTLVGIGTRCFDLAALNNIKPELAYCDVVIEPPEISRFSRFSVSNVQRMFDIGYEETQKHLAYIADHIDRREDDTVRAAAK

SEQ ID NO: 655 - DNA, 927 bp, Unknown
  Obtained from environmental sample
atgtcacttgatccacaaacgaaatttgtattagcccaattggctgctgccgatgctcctccaatggagactttgtcaccggaaatggctagacaggcattcatattgccgcaaggtgcagtggaggaagtagggaaggtagaaaatcgaacgattcctggtcctgcaacggacatccctgtccgtgtttattaccctaaagaactccagcctgaaaatcccgcgctagttttctatcatggcggcggctgggtaattggcaatttggactctcatgacgatatttgccgtgctttaaccaacctcgccaactgcgtgaccatttccgtcgactaccgcctggctccagagaataaatttcctgctgcggttgaggatgcttatgctgctgcacaatatgtgtatgaccatgcagaagatttcaaagtcgacaagacccgtattgccgttggcggtgacagtgccggtggaaatcttgccgctgtcgtgacgaatctggcaaaagacaaaaactcaccttctatttgtttccaacttctgatttatccaagcaccaatgcaggtggtgagccaacagcatcaatggttgagaatgcccatggctatttcttagaaaaaggcacgatggattggttccgtgactgctacctgaacagtgaagaagacaaacagaatccgctagtctcaccgatgctttatgatgatttccaaggactgcctccagcaattgtgattactgccgagtacgatccattgcgagatgaaggcgaagcatatgccaaaaagctgggcgaagcaggggttgctgtccaaaccatccgctttgacggtacgattcatggctttgtcagcatgtcggctgtcattagccaagggaaggcggcattggaaaaagcaggagaggctttaactaaagcctttcaataa

SEQ ID NO: 656 - protein, 308 aa, Unknown
  Obtained from environmental sample
MSLDPQTKFVLAQLAAADAPPMETLSPEMARQAFILPQGAVEEVGKVENRTIPGPATDIPVRVYYPKELQPENPALVFYHGGGWVIGNLDSHDDICRALTNLANCVTISVDYRLAPENKFPAAVEDAYAAAQYVYDHAEDFKVDKTRIAVGGDSAGGNLAAVVTNLAKDKNSPSICFQLLIYPSTNAGGEPTASMVENAHGYFLEKGTMDWFRDCYLNSEEDKQNPLVSPMLYDDFQGLPPAIVITAEYDPLRDEGEAYAKKLGEAGVAVQTIRFDGTIHGFVSMSAVISQGKAALEKAGEALTKAFQ

SEQ ID NO: 657 - DNA, 1236 bp, Bacteria
atgaataaaactattacgttacttagtgcattattactaccactaagttttgctcacgctgccgagccaacattgtctccagagatggtcagtgcctctcaagtaagaagcgcgcaagcgaaacaaacttacacttatgtccgctgctggtaccgcaccagttattcaaaagatgaacctgcgaccgattgggaatgggcagaaaatccagacggcagttacttcacgcttgatggctactggtggagttcggtttctttcaagaacatgttctacacagacacaccgcaaagtgttatcaagcaacgttgtgagcaaactctggacctagcaaatgaaaacgctgacatcaccttctttgcagccgataaccgtttctcctacaaccatactatctggagcaacgaccctgtcatgcagccagaccaaatcaacaaggtcgtagcattgggtgacagcttgtctgatacaggcaacatctttaatgcatcacaatggcgattcccgaatccaaatagctggttcttgggacacttctcaaacggttttgtgtggactgagtacattgctcaagcgaaaaacttaccgctatacaactgggctgtaggcggcgcggcaggcgaaaaccaatacatcgctctgactggtgtaggtgagcaagtttcctcttacttggcatatgcgaaattagcgaaaaactacaagcctgctaataccctgtttacccttgagtttggtctaaatgacttcatgaactacaaccgtagcgtgccagaagtgaaatcagactacgcggaagccttgattaaactgaccgatgcaggtgcgaagaacttgttgttgatgacactaccagatgcaacacgtgcaccacagtttacctactcgactcaagaagaaatcaacaagatccgcgcgaagatcgtggaaatgaatgagttcatcaaagcacaagcggcgtattacactgcacaaggctacaacgttaccttgtacgatacgcatgcactgtttgaaagcttaacagcaaatccagagcaacacggttttgtaaacgcgagccaagcttgccaagacatcaaccgctcttcatcggtggattacctataccatcatgcattgcgttctgagtgtgcgtcttctggctctgataagtttgtattctgggacgtaacgcacccgaccacagcaacacaccattacgtggcagaaaaaatgctagaaagtacgaatcaa

SEQ ID NO: 658 - protein, 412 aa, Bacteria
  SIGNAL (1)...(20)
  DOMAIN (147)...(406): GDSL-like Lipase/Acylhydrolase
MNKTITLLSALLLPLSFAHAAEPTLSPEMVSASQVRSAQAKQTYTYVRCWYRTSYSKDEPATDWEWAENPDGSYFTLDGYWWSSVSFKNMFYTDTPQSVIKQRCEQTLDLANENADITFFAADNRFSYNHTIWSNDPVMQPDQINKVVALGDSLSDTGNIFNASQWRFPNPNSWFLGHFSNGFVWTEYIAQAKNLPLYNWAVGGAAGENQYIALTGVGEQVSSYLAYAKLAKNYKPANTLFTLEFGLNDFMNYNRSVPEVKSDYAEALIKLTDAGAKNLLLMTLPDATRAPQFTYSTQEEINKIRAKIVEMNEFIKAQAAYYTAQGYNVTLYDTHALFESLTANPEQHGFVNASQACQDINRSSSVDYLYHHALRSECASSGSDKFVFWDVTHPTTATHHYVAEKMLESTNQ

SEQ ID NO: 659 - DNA, 933 bp, Unknown
  Obtained from environmental sample
atgctcctcccgttgttcgtgaccgcgtgtgtcggcgtggtcgagggcggagagagtgatcgacccgacgcggtcgagaccacgcccgggtccgcgcccggcccgacgccggatccgccgcgcgcgctgcccgcggggaagctcgcgatcgtcctcgcccacgggctcgacggcaacgtcgacagcttcgaccccgcgatcgtcgccgcgatccaggcggacggtcacgtggtgaagcgcaccgaggtgccggcggtcgacagcatcgcagtgcgcgcggcggcgctcggcccgcagatcgaccggttcctcaccgagaccggcgccacgcaggtccacatcatcgcgcactcgatgggcggcctcgattcgcgctacctgatctcgaagctcgggtacgcgagcaaggtcgcgtcgctgacgacgatgtcgacgccgcaccggggctcgccgatcgcggacgtggcgctcggcctcaccacgagctcgctgctcagccagtccgccgcgctcgatgcgctcaccgcgctgttcggcaccgacccggcgtcgctcgaccgcgcgctcgtcgacctcagcgtccgccaggccgaggtgttcaacgcgacggtcaccgacgccccgggcgtgaagtacttctcgtacgccggcttcagcacgccgggtcaggtcagcaacagcaacgcggccgcgagctgcgggacgctgccgcccggcccgacgcagaccgccctcgcggtcgtgcagccgatcgtcgcgaacggcttcgaccggatcccgagcgacgcggtcgtctcgatcccgagcgcgacctggggcacgttcctcggctgcgtcgccgccgaccacctctccgagatcaaggcgccgacgccgacccacgactcggcgacgttcttcaaaaacgtcgtcgcgcggctcgcgacgctgtga

SEQ ID NO: 660 - protein, 310 aa, Unknown
  Obtained from environmental sample
MLLPLFVTACVGVVEGGESDRPDAVETTPGSAPGPTPDPPRALPAGKLAIVLAHGLDGNVDSFDPAIVAAIQADGHVVKRTEVPAVDSIAVRAAALGPQIDRFLTETGATQVHIIAHSMGGLDSRYLISKLGYASKVASLTTMSTPHRGSPIADVALGLTTSSLLSQSAALDALTALFGTDPASLDRALVDLSVRQAEVFNATVTDAPGVKYFSYAGFSTPGQVSNSNAAASCGTLPPGPTQTALAVVQPIVANGFDRIPSDAVVSIPSATWGTFLGCVAADHLSEIKAPTPTHDSATFFKNVVARLATL

SEQ ID NO: 661 - DNA, 1251 bp, Unknown
  Obtained from environmental sample
atgaaatgctgtcgggttatgtttgtgttgctcggattatggcttgtattcggcctatcggtcccgggagggcgagctgaagcggcagtttcacgcgccaacgatgcgccgattgtacttctccatggctttactggctggggaagagaagaaatgtttgggttcaagtactggggcggcgtgcgcggcgatatcgaacaatggctgaacgacaacggttatcgaacttatacgctggcggtcggaccgctctcgagcaactgggaccgggcgtgtgaagcgtatgctcagcttgtcggcgggacggtcgattatggggcagcccatgcggcaaagcacggccatgcgcggtttggccgcacttatcccggcctgttgccggaattgaaaaggggtggccgcatccatatcatcgcccacagccaaggggggcagacggcccgcatgcttgtctcgctcctagagaacggaagccaagaagagcgggagtacgccaaggcgcacaacgtgtcgttgtcaccgttgtttgaaggtggacatcatgttgtgttgagtgtgacgaccatcgccactcctcatgacgggacgacgcttgtcaacatggttgatttcaccgatcgcttttttgacttgcaaaaagcggtgttgaaagcggcggctgtcgccagcaacgtgccgtacacgagtcaagtatacgattttaagctcgaccaatggggactgcgccgccagccgggtgaatcgttcgaccattattttgaacggctcaagcgctcccctgtttggacgtcgacagataccgcccgctacgatttatccgtttccggagctgagaagttgaatcaatgggtgcaagcaagcccgaatacgtattatttgagctttgccacagaacggacgtatcgcggagcgctcacaggcaactattatcccgaactcggaatgaatgcattcagcgcggtcgtatgcgctccgtttctcggttcgtaccgcaatccgacgctcggcattgacgaccgctggcttgaaaacgatggtattgtcaatacggtttccatgaacggtccaaagcgtggatcaagcgatcggatcgtaccgtatgacggggcgttgaaaaaaggggtttggaatgacatgggaacgtacaatgtcgaccatttggaaatcatcggcgttgacccgaatccgtcatttgatattcgcgccttttatttgcgacttgccgagcaattggcgagcttgcggccttaa

SEQ ID NO: 662 - protein, 416 aa, Unknown
  Obtained from environmental sample
  SIGNAL (1)...(28)
MKCCRVMFVLLGLWLVFGLSVPGGRAEAAVSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHVVLSVTTIATPHDGTTLVNMVDFTDRFFDLQKAVLKAAAVASNVPYTSQVYDFKLDQWGLRRQPGESFDHYFERLKRSPVWTSTDTARYDLSVSGAEKLNQWVQASPNTYYLSFATERTYRGALTGNYYPELGMNAFSAVVCAPFLGSYRNPTLGIDDRWLENDGIVNTVSMNGPKRGSSDRIVPYDGALKKGVWNDMGTYNVDHLEIIGVDPNPSFDIRAFYLRLAEQLASLRP

SEQ ID NO: 663 - DNA, 489 bp, Unknown
  Obtained from environmental sample
atgaatcggctgcacaagtcgacgctcaagatagagcgcctggaaatcgcggaaggtcgcaagatgctctgtgacctcaagcagaaccgcgagagacgctatccgcttgactgcggcgtgagactttcggtcattacgaaccaagggacgctgcacgtgcagactgcccccggcttcgtattcgacgggcggagcggcccgaaaatagtggactggtacgccccgaacctcggcaacctctacgagattgtctgctggttcgtacacgactgcaacggctacggccaggacttgagcttcaaggacacaaacatcatgctgtacgccatgctgcgcgacctcgcggagtaccgaccgaccaagtgcgccgtaatccagctcgccgtgagcctttcggattcgtggtacggagagccgaagaaggacgactggtgctacgccaaccgccacctcgtatctacgctgtggatcccgaaggaggccgcataa

SEQ ID NO: 664 - protein, 162 aa, Unknown
  Obtained from environmental sample
MNRLHKSTLKIERLEIAEGRKMLCDLKQNRERRYPLDCGVRLSVITNQGTLHVQTAPGFVFDGRSGPKIVDWYAPNLGNLYEIVCWFVHDCNGYGQDLSFKDTNIMLYAMLRDLAEYRPTKCAVIQLAVSLSDSWYGEPKKDDWCYANRHLVSTLWIPKEAA

SEQ ID NO: 665 - DNA, 1155 bp, Unknown
  Obtained from environmental sample
atgaagggaatcgtggtattcatgatttcggtattcatttctctgttgcctgtttttgatgtatctgccgtcgagaacgtgacccagatatttgataaaggcaaccctgtagaatattttatctcgacaaaggacggctggaggctcgcgctttaccggtataagcccgatgttatcaaggaaggaacggatcccgttatcctctgccatgggtttaacatgaacagcaacttctgggaccttgacaccgcgcacagttttgccaggtacctccgagataatggttacgatgtctggagcgtcaatctgcgcggctcaggcgattcctcaaagcctgtcatggcagatttgaggggttttaccaaactgcagattgtcaaatggccgcgcacgatcgcgagcatcccgttcgaccttgataagttcaaatggtccttcgatgaccacgtgaataaagacattccggcagtcatagatttcgtgaagaaaaggaccggcaaagagaaggtcgtctggttcggccacagcatgggcgggatggtcatgtatgcctacctgaccactcatgaccagagcgacataagggccttcgcggcgatggggtctacaatgcatttcggcaagacactcggcgatgaagattccttcaatacgatacttgagcaccgcaggctcaggaacggggcgctcctcatcaataccactattgcctcccagataatgaacctctctttgggggcgatagggaataagtgggaagaggatatgtataaccccgataatattgacaggttattggccatgcgcttattccgtctcgccatcaatgatacctcccccggtgtagtcgacgcgtacgccaacctgcttgagacatgcgaacttaagaatgccgatgggactttcagctataccggaaacctcgataaggtcagcgtgccgttacttatcaccgtagcggctgtcgaccccttcggcaccatggagatatcgcgttatgcctatgaccatgtctcgtctgccgataaggagatcatagagttttccaaatcggcgggcaagtcggccgattacggccattgtgatataatacttggcaagagagcgccggaagaggtatttcccgcgctgctcgaatggctccagaatagataa

SEQ ID NO: 666 - protein, 384 aa, Unknown
  Obtained from environmental sample
  SIGNAL (1)...(23)
  DOMAIN (96)...(376): alpha/beta hydrolase fold
MKGIVVFMISVFISLLPVFDVSAVENVTQIFDKGNPVEYFISTKDGWRLALYRYKPDVIKEGTDPVILCHGFNMNSNFWDLDTAHSFARYLRDNGYDVWSVNLRGSGDSSKPVMADLRGFTKLQIVKWPRTIASIPFDLDKFKWSFDDHVNKDIPAVIDFVKKRTGKEKVVWFGHSMGGMVMYAYLTTHDQSDIRAFAAMGSTMHFGKTLGDEDSFNTILEHRRLRNGALLINTTIASQIMNLSLGAIGNKWEEDMYNPDNIDRLLAMRLFRLAINDTSPGVVDAYANLLETCELKNADGTFSYTGNLDKVSVPLLITVAAVDPFGTMEISRYAYDHVSSADKEIIEFSKSAGKSADYGHCDIILGKRAPEEVFPALLEWLQNR

SEQ ID NO: 667 - DNA, 1422 bp, Unknown
  Obtained from environmental sample
atgaaaaggaaactatgtacatgggctctcgtaacagcaatagcttctagtactgcggtaattccaacagcagcagaagcttgtggattaggagaagtaatcaaacaagagaatcaagagcacaaacgtgtgaaaagatggtctgcggagcatccgcatcattcacatgaaagtacccatttatggattgcacaaaatgcgattcaaattatgagccgtaatcaagataagacggttcaagaaaatgaattacaatttttaaatacccctgaatataaggagttatttgaaagaggtctttatgatgctgattaccttgatgaatttaacgatggaggtacaggtataatcggcattgatgggctaattcgaggagggtggaaatctcatttctacgatcccgatacaagaaagaactataaaggggaggaagaaccaacagctctttctcaaggagataaatattttaaattagcaggtgaatactttaagaagaatgattggaaacaggctttctattatttaggtgttgcgacgcactactttacagatgctactcagccaatgcatgctgctaattttacagctgtcgacaggagtgctataaagtttcatagtgcttttgaagattatgtgacgacaattcaggaacagtttaaagtatcagatggagagggaaaatataatttagtaaattctaatgatccgaaacagtggatccatgaaacagcgagactcgcaaaagtggaaatcgggaacattaccaatgatgtgattaaatctcactataataaaggaaacaatgctctttggcagcaagaagttatgccagctgttcagagaagtttagaacaagcccaaagaaatacggcgggatttattcatttatggtttaaaacatatgttggaaaaacagctgctgaagatattgaaaatactatagtgaaagattctaggggagaagcaatacaagagaataaaaaatactttgtagtaccaagtgagtttttaaatagaggcttaacatttgaagtgtatgctgcttatgactatgcgttattatctaaccatgtggatgataataatattcatggtacaccggttcaaattgtatttgataaagaaaataatgggatccttcatcaaggagaaagtgcattgttaaagatgacacaatccaactacgataattatgtatttctaaattattctatcataacaaattgggtacatcttgcaaaaagagaaaacaatactgcacagtttaaagtgtatccaaatccaaataatccaactgaatatttcatatatacagatggctatccagttaattatcaagaaaaaggtaaagagaaaagctggattgttttaggaaagaaaacggataaaccaaaagcatggaaatttatacaggcggaataa

SEQ ID NO: 668 - protein, 473 aa, Unknown
  Obtained from environmental sample
  SIGNAL (1)...(27)
  DOMAIN (1)...(303): Zinc dependent phospholipase C
MKRKLCTWALVTAIASSTAVIPTAAEACGLGEVIKQENQEHKRVKRWSAEHPHHSHESTHLWIAQNAIQIMSRNQDKTVQENELQFLNTPEYKELFERGLYDADYLDEFNDGGTGIIGIDGLIRGGWKSHFYDPDTRKNYKGEEEPTALSQGDKYFKLAGEYFKKNDWKQAFYYLGVATHYFTDATQPMHAANFTAVDRSAIKFHSAFEDYVTTIQEQFKVSDGEGKYNLVNSNDPKQWIHETARLAKVEIGNITNDVIKSHYNKGNNALWQQEVMPAVQRSLEQAQRNTAGFIHLWFKTYVGKTAAEDIENTIVKDSRGEAIQENKKYFVVPSEFLNRGLTFEVYAAYDYALLSNHVDDNNIHGTPVQIVFDKENNGILHQGESALLKMTQSNYDNYVFLNYSIITNWVHLAKRENNTAQFKVYPNPNNPTEYFIYTDGYPVNYQEKGKEKSWIVLGKKTDKPKAWKFIQAE

SEQ ID NO: 669 - DNA, 765 bp, Unknown
  Obtained from environmental sample
atgaataagaatgatattgatgaggtggatagattgaacaaaaaatatgaatatgaaaaaaaaggcccaaaagcggttattttattccatgcttatacgggaacaccaaatgatgtgaatagtgttgctagagctttagaaagagaaaattataccgtgttatcaccaacccttgacggtcacggtttggaggatcccaatgagttgttagagtatgggattgaagactggataaaaaatggggaagaagcctatcaaactttaagagaagatggctatacggatatttccgtttttggcttatcgttaggtggagttgttgccacagatattatgctaaaacatgacgtgaagagttatggtgttttctcatcaccagtcattacaaatgaagactcaaacgtgccccaaaatttctggctatggtacaaattcaaaatgaaaaaactaggcatggatcaaaaagaaattgaagagaacaaacaagaagtaatgaaaaaagtagaaaaacgattaaaagaaatcaatgactatgtagcaacaatgtccgctaaatacgaagaaattgaaatacctgtatttattggccaaggtggtcaagatgaaatggtcaatccaaatcatgcctatacatttaaagacagattagtaaatgctgaagtggattttcattggtatgaagaagcgcctcacgtcattaccgttggacgcatcggaaaagaattacaagaagatttactcgaatttttagagaaatatgcctaa

SEQ ID NO: 670 - protein, 254 aa, Unknown
  Obtained from environmental sample
MNKNDIDEVDRLNKKYEYEKKGPKAVILFHAYTGTPNDVNSVARALERENYTVLSPTLDGHGLEDPNELLEYGIEDWIKNGEEAYQTLREDGYTDISVFGLSLGGVVATDIMLKHDVKSYGVFSSPVITNEDSNVPQNFWLWYKFKMKKLGMDQKEIEENKQEVMKKVEKRLKEINDYVATMSAKYEEIEIPVFIGQGGQDEMVNPNHAYTFKDRLVNAEVDFHWYEEAPHVITVGRIGKELQEDLLEFLEKYA

SEQ ID NO: 671 - DNA, 891 bp, Unknown
  Obtained from environmental sample
atggatggcggcacggccaaggtgggcgacggcatcgcctatgccgacgggccgcggcacaagctcgacatctatgcgcccgagcaacgcggcgcgcccgccccggtcgtgtttttcatctatggcggcggctggaaccggggcgagcgcagcgactatcagttcgtcgggcgcgccctggcctcgcgcggcttcgtcactgtcattgccgactatcggctggtgccggaagtacggtttcccggcttcctgaccgacagcgccaatgcgttgcgctgggtgcaggacaatattgccaattacggcggcgaccccaatcggctgtttctcgccgggcattcggccggtgcctataatgcggtcatgctggcgctcgaccctgcctatcggcaggaattcggcgtcaccatgccgatcctggcggtggcggccctgtcgggcccctatgatttctatccgttcgaatatttcgaggtgcaggaggctttcggccaggcgcccaatccggaagggacgcagccgatcaacctgatcaccgccgaggcgccaccgatgtatctggcgaccggcactaccgatccgatcgtgcgggtgcagaataccgaacgctttgccgatcggctgcgggcccagggcgtgtgggtgacgaccagatattacgaggggttcgggcatatggaaccggtgatcgccatgggcgcgctgtggcgttggcgcatgccggtactcgatgagatggtcggctttttccagcgtttcggcgcctttcccagcggcgtgccctatctcgccgtgacgccggaagcgccacaaatgctgcccgattcggtggcgccgaccgatgaaatcgtccgccagctcaacgagatgttccagccgatcgaggaatag

SEQ ID NO: 672 - protein, 296 aa, Unknown
  Obtained from environmental sample
MDGGTAKVGDGIAYADGPRHKLDIYAPEQRGAPAPVVFFIYGGGWNRGERSDYQFVGRALASRGFVTVIADYRLVPEVRFPGFLTDSANALRWVQDNIANYGGDPNRLFLAGHSAGAYNAVMLALDPAYRQEFGVTMPILAVAALSGPYDFYPFEYFEVQEAFGQAPNPEGTQPINLITAEAPPMYLATGTTDPIVRVQNTERFADRLRAQGVWVTTRYYEGFGHMEPVIAMGALWRWRMPVLDEMVGFFQRFGAFPSGVPYLAVTPEAPQMLPDSVAPTDEIVRQLNEMFQPIEE

SEQ ID NO: 673 - DNA, 873 bp, Unknown
  0
atgaatcattttgtttatttaatggataaatatggcaatccatattctttttccttaaaaccaaaatattataaaacattggtactttctggtggcgcaatgcgtggtgtatatttattgggagcattaaatggtttaaaaataaaaataaacaaaatatcaacgtttataggtatatcatctggttctataatatgttttttattaagtatagggtatactccatatgaaatttttataagtttattaaaatatgataatctcttgactattaatttagataaattatattcaggtgataccaggaatgaaggaggattgttttcaagtgagaatatctttaaacatcttgaaactcaaatgcgtttaaaagaaatttcaagatctataacttttaaagaacattttgaaaaaacaggtaaaatattaattgttatggcttttaatattacaaaatgtaaagaagacatatttacatatgaaacaactcctgatatggaaattttgaattctttaaaattaagcgcaagaatcccaatcatatttggacccataaaatataataataatttttatatagacggaggcgtttggaacaattttccaattgatattgcaattaagtatcataataaaaaaaataaaaagaaaagtgattggataatagctgtaacaaccttgttttcaacttacaaacaaaatatacatcaatggtataaattttcaaatataaatattgttatggtaaatgatacacccgatttaaatccatcattagtatcatctgatttagaaaaattaactatgtttaacaaaggagaagaaaaagcgagtcttattaaaaaacaaaatattcgtagaaatagtatataa

SEQ ID NO: 674 - protein, 290 aa, Unknown
  0
  DOMAIN (27)...(207): Patatin-like phospholipase
MNHFVYLMDKYGNPYSFSLKPKYYKTLVLSGGAMRGVYLLGALNGLKIKINKISTFIGISSGSIICFLLSIGYTPYEIFISLLKYDNLLTINLDKLYSGDTRNEGGLFSSENIFKHLETQMRLKEISRSITFKEHFEKTGKILIVMAFNITKCKEDIFTYETTPDMEILNSLKLSARIPIIFGPIKYNNNFYIDGGVWNNFPIDIAIKYHNKKNKKKSDWIIAVTTLFSTYKQNIHQWYKFSNINIVMVNDTPDLNPSLVSSDLEKLTMFNKGEEKASLIKKQNIRRNSI

SEQ ID NO: 675 - DNA, 948 bp, Unknown
  Obtained from environmental sample
atgaaaacactattccgtctagcattgattcttacccttattctatcctgcgcatatattaatgctcagcataaggttatacatgtctggccaggtgttgcccccggatctgaggactggaaatattctgaaattgaatacctgaatgagcagaatcagaagatggtccgtaatgttgttactccaactcttacagcctatttgcccgatcctgctaaggccacaggtacggcggtaatagttgccccgggaggaggatttcgcttcctctcctggcaggatgaaggtacagaggtagcagagtggcttgtaaaccatgggattgctgctttcgttttgaaataccggcttgttaataccggtgccacccaggaagagtttcaaaaagccataatgacaatggttgctgaaataaatgcttcgatgcaagctgaaaatgaaggcaaacctgccggaaatataactgaaaataaaaacttttcagaacctgcacaaattggaatcgaagacgggaaacaggcaatatggctactacgcaagcaggctgcaaagtatggaataaagcccaatcgcattggcattataggattttctgcaggaggtatggtaacactgggcgcagcccttacaacagatcctgaaagccgtcccgattttgccggcgccatatatgctccatggtcgggaggtgccgtttctgaggataccccgccaattttcatccttgctgctgctgacgacaaacttgcagctcctggcagtatattgacatataacaactggattgcagccggaaggcaggccgaacttcatatttattcaaagggaggacatggctttggcatgcagaagaaagggcttcctgttgatagctggattgaaagattcggagactggatgaagtctcagggactaatgacaattacagaaaaaaccacagtaaaatga

SEQ ID NO: 676 - protein, 315 aa, Unknown
  Obtained from environmental sample
  SIGNAL (1)...(22)
MKTLFRLALILTLILSCAYINAQHKVIHVWPGVAPGSEDWKYSEIEYLNEQNQKMVRNVVTPTLTAYLPDPAKATGTAVIVAPGGGFRFLSWQDEGTEVAEWLVNHGIAAFVLKYRLVNTGATQEEFQKAIMTMVAEINASMQAENEGKPAGNITENKNFSEPAQIGIEDGKQAIWLLRKQAAKYGIKPNRIGIIGFSAGGMVTLGAALTTDPESRPDFAGAIYAPWSGGAVSEDTPPIFILAAADDKLAAPGSILTYNNWIAAGRQAELHIYSKGGHGFGMQKKGLPVDSWIERFGDWMKSQGLMTITEKTTVK

SEQ ID NO: 677 - DNA, 717 bp, Unknown
  Obtained from environmental sample
atgtcggcaatggggacagttcgaaaagtgcttgaaggaggacggctttcggtcctcggcttcgcgatcgcggcgcttgccttcacatcgccggcgcacgcgcaggacgacaagatgattccgatcgcgatcccggcgcagccgaacgcgatcatgctcggaaccggtccgctgccgggcgccaccgcaccggaagtgtggcacaggcaatatggcagcctgtttgcgcgcaacgtcaccgtcgcgaccctcaccccctatctgcccgaccccgcgaaagccaacggcacggcggtgatcgtcgcgcccggtggtggtttccggacgctgtcgatggagaatgaggggtccgacgtcgccaaggcgctggcggcgcgcggcgtcgccgccttcgtgctcaaataccggctgaaccagaccccgcaggacatggcggagttcgaccgctcgatgacggcgatgttcgccagtgccgcgcgcccgacgacccgcctcaagcccgaagcggcgatcgccaaccttgcgccgcagatcgccgacgcccgtgcggccttcgcgctcgtccgcaagcgggcgggtgagtggcgggtcgaccccagccggatcgggatggtcggcttctcggccggtgccatgctgacgatggcgaccactttggcggggcaggatgccaagcccgccttcatcgggctggtctacggctcgctggagcggtga

SEQ ID NO: 678 - protein, 238 aa, Unknown
  Obtained from environmental sample
  SIGNAL (1)...(34)
MSAMGTVRKVLEGGRLSVLGFAIAALAFTSPAHAQDDKMIPIAIPAQPNAIMLGTGPLPGATAPEVWHRQYGSLFARNVTVATLTPYLPDPAKANGTAVIVAPGGGFRTLSMENEGSDVAKALAARGVAAFVLKYRLNQTPQDMAEFDRSMTAMFASAARPTTRLKPEAAIANLAPQIADARAAFALVRKRAGEWRVDPSRIGMVGFSAGAMLTMATTLAGQDAKPAFIGLVYGSLER

SEQ ID NO: 679 - DNA, 705 bp, Unknown
  Obtained from environmental sample
atgagccagaccttacatttacaatttacccgactagccgacttggattgtttggcattacctcttcaggcggaccgcccaaccatcgtgatgttgcatggttatggcgctaattttgaggatcttgccggtctcgttccgatgcttgatccaaagggccaatggaactggatctttccgaatggcattttggaagtaccgatagaccaacatgtgatgggacgtgcctggtttccaatcgacatggaggccttgcaacggcatttgatggggggtgaagtacgcagcttcgcccatcatattcccgcagggctcgaaactgcccaaaagcggatcggtgaattgatttcggctttgggtatcaaagccgaagatttggtacttgcaggctttagtcagggcgcgatggtgacgtgccatacaatgatggctatgaaggaaaaccccagggcactgattcagctttcatccacattggtttccgaagaaacctgccgggaaaacatgccccggcaccaagatcttaaaatcttccaaagccacggccaattcgatccgttattgccgattgcggcagccagagaactcaagcaggtgtttgaagcctcatccagccatgtcgattaccacgagtttgccggggctcacgagattcctctgccgattatccaaaagcttgggagctttctgcaaagcctgctctaa

SEQ ID NO: 680 - protein, 234 aa, Unknown
  Obtained from environmental sample
  DOMAIN (15)...(234): Phospholipase/Carboxylesterase
MSQTLHLQFTRLADLDCLALPLQADRPTIVMLHGYGANFEDLAGLVPMLDPKGQWNWIFPNGILEVPIDQHVMGRAWFPIDMEALQRHLMGGEVRSFAHHIPAGLETAQKRIGELISALGIKAEDLVLAGFSQGAMVTCHTMMAMKENPRALIQLSSTLVSEETCRENMPRHQDLKIFQSHGQFDPLLPIAAARELKQVFEASSSHVDYHEFAGAHEIPLPIIQKLGSFLQSLL

SEQ ID NO: 681 - DNA, 636 bp, Unknown
  Obtained from environmental sample
atgaaaaatcctatgaagaagctgtccatgctggtgtttatgacatcggtaatgtttgcgagcgttgcccatgcatgtaacgcaacgcctatcgtttttgtccacggctattctggctggaaatcccagtttgataccatgataaaccgtttccagaatgacggtacgcctgcctgtgcgatgtataaattcggttataacagtttgggcaacagcaacaagaccagtgcccggcaactgagagatttcgttaacaacatccggcccaatcacggtaaccgcagagccaacatcattgctcactccaatggtggtctggtttcacgctggtaccgggtgtttgagggcggtaacaatgctactgatcggctgatcaccctgggtactccccatcagggtacttcctgggcctatgcctgtttcagtccggcctgcttcgagatgcgttacaactcgtccttcctgcgggacctgaacggacgcggttgtgatgtgtcactttggtcggccgttgatgaaatcattattccgcagaccaatgcgcgttgtggcaacagccgccggacctccagtgtgggtcatataacgctcatgtactggggcggtgtctataatgatgtgaggcgctacctgtaa

SEQ ID NO: 682 - protein, 211 aa, Unknown
  Obtained from environmental sample
  SIGNAL (1)...(25)
  DOMAIN (28)...(209): Lipase (class 2)
MKNPMKKLSMLVFMTSVMFASVAHACNATPIVFVHGYSGWKSQFDTMINRFQNDGTPACAMYKFGYNSLGNSNKTSARQLRDFVNNIRPNHGNRRANIIAHSNGGLVSRWYRVFEGGNNATDRLITLGTPHQGTSWAYACFSPACFEMRYNSSFLRDLNGRGCDVSLWSAVDEIIIPQTNARCGNSRRTSSVGHITLMYWGGVYNDVRRYL

SEQ ID NO: 683 - DNA, 1686 bp, Unknown
  Obtained from environmental sample
atgagtatcttcaattacaagaatgcccttggcggtgacggcaaggccctctacagcgaggccattacgttggccctgtatgcctccacacccaccggcgaggccttgccgggcaccgcctggcgaccgatcagcgccagcaagctgggctaccagggcaacgtcagcgcccagggcacgatttccggcgagcaggcgatcgtcagcgacgcccagatcgaggtgctgggcaagtacgacgccagcgggcagctgctgtccatcggcctcagctttcgcggcaccgacagcctcaaggacggcatcaacgacctgcaggcggccttcgtctcgggctttgccgacaactacagccgcctggccttcgacaacctgttgggcaaggtagcggcgttcgccgtggcccagggcttgcgcggcagcgatgtgctggtcaccggccacagcctgggcgggcttggggtcaacagcctggcgaccatgagcacggagcactggggcggcttctaccaggacgccagctacgtggccttcgcctcgccaacgcagagcggcagcggcccgcaggtgctgaacatcggctatgaaaacgacccggtgttccgcgccctggatggcacgcatttcaacgcttcatccctgggcacccacgacaagccccaggagtcggcgaccaacaacattgtcagtttcaccgatcactattcatcgttccttggccagctgattccccagagcatcctcaacctcaagtcctggaccgcccacagcgcggtggattacgccgccggcctcaaccgcctgatcgactcggacttctatgacctgaccagccgtgattcgacggtggtggtctccaacctgtccgagggcaagcgcgatcaggtctgggtcaaggacctcaacctgtacgcggaaaaacacaccggcagcaccttcatcatcggcacccagagcaacgacctgctgcacggcggcaagggcaacgactatctggacggtggcgccggcaatgaccgtttccgcgatgacggcggctacaacatcatccatggcggccagggccataacgtgctggagctgcaacagccgttgaagaacttctccatcgccaacgacggcgacggcaccctgtatatccgcgatgcctacggcggcatcagcatgacccgcgacgtcggcgccctggtcagtcatgaggccgggagctggtggcaactgttcggcaaggacgtcagctacagcgtgaccgccgatggcttgcagaacggcaaccagtggaccgcctacaaccactcgctcaatggcgatgcctatggcaatgcgctggtggccagcgtcaacggcgactggctgttcggccatggcggcgatgacttgctgagcagcgacaaggccaacgtgaccttcgtcggcggcagcggcaacgacgtcatgcattccagtggtggcggggccaataccttcctgttcagcggcaacttcggctttgacctgatccacggctaccagaacagcgacaagctggtgttcatgggcgtgcccggggtcgacgcgcagtacgactacagccagcacctgtcgcagaacggcaacgacaccctgctcagtgtcggcgagttctcggtgaccctggtgggggttggcatggacagcctgtccggatcgagcctggtcttcgcctga

SEQ ID NO: 684 - protein, 561 aa, Unknown
  Obtained from environmental sample
  DOMAIN (85)...(208): Lipase (class 3)
  DOMAIN (324)...(341): Hemolysin-type calcium-binding repeat (2 copies)
MSIFNYKNALGGDGKALYSEAITLALYASTPTGEALPGTAWRPISASKLGYQGNVSAQGTISGEQAIVSDAQIEVLGKYDASGQLLSIGLSFRGTDSLKDGINDLQAAFVSGFADNYSRLAFDNLLGKVAAFAVAQGLRGSDVLVTGHSLGGLGVNSLATMSTEHWGGFYQDASYVAFASPTQSGSGPQVLNIGYENDPVFRALDGTHFNASSLGTHDKPQESATNNIVSFTDHYSSFLGQLIPQSILNLKSWTAHSAVDYAAGLNRLIDSDFYDLTSRDSTVVVSNLSEGKRDQVWVKDLNLYAEKHTGSTFIIGTQSNDLLHGGKGNDYLDGGAGNDRFRDDGGYNIIHGGQGHNVLELQQPLKNFSIANDGDGTLYIRDAYGGISMTRDVGALVSHEAGSWWQLFGKDVSYSVTADGLQNGNQWTAYNHSLNGDAYGNALVASVNGDWLFGHGGDDLLSSDKANVTFVGGSGNDVMHSSGGGANTFLFSGNFGFDLIHGYQNSDKLVFMGVPGVDAQYDYSQHLSQNGNDTLLSVGEFSVTLVGVGMDSLSGSSLVFA

SEQ ID NO: 685 - DNA, 1422 bp, Unknown
  Obtained from environmental sample
atgaaaaagaaattatgtacatgggctctcgtaacagcgatatcttctggagttgttgcgattccaaccgtagcatctgcttgcggaatgggtgaagtaatgaaacaggaggatcaagagcacaaacgtgtgaagagatggtctgcggagcatccgcaccatgctaatgaaagcacgcacttatggattgctcgaaatgcgattcaaattatgagtcgtaatcaagataagacggttcaagaaaatgaattacaattcttaaaaatacctgaatataaggagttatttgaaagagggctttatgatgccgattatcttgatgagtttaacgatggaggtacaggtacaatcggtattgatgggctaattaaaggaggctggaaatctcatttctatgatcctgatacgaaaaagaactataaaggagaagaagaaccaacagccctttcgcaaggggataaatattttaaattagcaggagattattttaagaaagaagattggaaacaagctttctattatttaggtgttgcgacgcattacttcacagatgctactcagccaatgcatgctgctaattttacagctgtcgacatgagtgcaataaagtttcatagcgcttttgaaaattatgtaacgacagttcagacaccgtttgaagtgaaggatgataagggaacatataatttggtcaattctgatgatccgaagcagtggatacatgaaacagcgaaactcgcaaaagcagaaattatgaatattactagtgataatattaaatctcaatataataaaggaaacaaagatctttggcaacaagaagttatgccagctgtccagaggagtttagagaaagcgcaaagaaacacggcgggatttattcatttatggtttaaaacatatgttggcaaaactgcagctgaagatattgaaactacacaggtaaaagattctaatggagaagcaatacaagaacaaaaaaaatactacgttgtgcctagtgagtttttaaatagaggtttgacctttgaggtatatgcttcgaatgactacgcactattatctaatcacgtagatgataataaagttcatggtacacctgttcagtttgtttttgataaagagaataacggaattgttcatcggggagaaagtgtactgctgaaaatgacgcaatctaactatgatgattatgtatttcttaattactctaatatgacaaattggttacatcttgcgaaacgaaaaacaaatactgcacagtttaaagtgtatccaaatccggataactcatctgaatatttcctatatacagatggatacccggtaaattatcaagaaaatggtaatggaaagagctggattgagttaggaaagaaaacggataaaccgaaagcgtggaaatttcaacaggcagaataa

SEQ ID NO: 686 - protein, 473 aa, Unknown
  Obtained from environmental sample
  SIGNAL (1)...(20)
  DOMAIN (1)...(303): Zinc dependent phospholipase C
MKKKLCTWALVTAISSGVVAIPTVASACGMGEVMKQEDQEHKRVKRWSAEHPHHANESTHLWIARNAIQIMSRNQDKTVQENELQFLKIPEYKELFERGLYDADYLDEFNDGGTGTIGIDGLIKGGWKSHFYDPDTKKNYKGEEEPTALSQGDKYFKLAGDYFKKEDWKQAFYYLGVATHYFTDATQPMHAANFTAVDMSAIKFHSAFENYVTTVQTPFEVKDDKGTYNLVNSDDPKQWIHETAKLAKAEIMNITSDNIKSQYNKGNKDLWQQEVMPAVQRSLEKAQRNTAGFIHLWFKTYVGKTAAEDIETTQVKDSNGEAIQEQKKYYVVPSEFLNRGLTFEVYASNDYALLSNHVDDNKVHGTPVQFVFDKENNGIVHRGESVLLKMTQSNYDDYVFLNYSNMTNWLHLAKRKTNTAQFKVYPNPDNSSEYFLYTDGYPVNYQENGNGKSWIELGKKTDKPKAWKFQQAE

SEQ ID NO: 687 - DNA, 885 bp, Unknown
  Obtained from environmental sample
atgctggtggaagaaaagatgcttttgatggcgcggcgtagtcgcgagaactatatggagaggatgggccccgtattggcagcgcgaccagcggcagtagaagtagaagagctaagcgtgtcgaccgcagccggcgaaacatcggtgtttttgtataaaccatgcgggctgtctgccaaatcgttgccggtctacctaaacattcatggcggcggctttattcagggaagtacgcaggatgacgatggctggtgccgccagattgccgccgcggtaggatgcatcgtggtcaatatcgagtaccatctggcgccggaatataaatttccgctgcaactggaagagtgctacgacgttattaaatgggtgcaggccacagcgaatgaaaatggatttgattcatcgcggattgccattggcggcagcagcgccggagcgaatttttcggcggcgctctgccagttggcacggcaaaggcaggacgtggctatttgctaccaggtgctgaactacccgccactcgatttcgtgacggacccggaaaccaagggggatcgggacccgctgcttactgcaaaggctcaggctttttttacagcctgctatctgcgcgattcgaccgatgccgccaacccgttggcatcgccgctgctggcggacagtttggctggattgccgccggctttgattattaccgcagaacttgatcctttatgcgctgaagatgagcggtatgccaagcggctggccgccgacggggtagcagtgacttatcggatgtttgccggctgttctcacgcatttactcattttggtcccgagccggccgcacaggaggcctggacgctgattcaggagaaattgcagcaagcatttaaccgataa

SEQ ID NO: 688 - protein, 294 aa, Unknown
  Obtained from environmental sample
MLVEEKMLLMARRSRENYMERMGPVLAARPAAVEVEELSVSTAAGETSVFLYKPCGLSAKSLPVYLNIHGGGFIQGSTQDDDGWCRQIAAAVGCIVVNIEYHLAPEYKFPLQLEECYDVIKWVQATANENGFDSSRIAIGGSSAGANFSAALCQLARQRQDVAICYQVLNYPPLDFVTDPETKGDRDPLLTAKAQAFFTACYLRDSTDAANPLASPLLADSLAGLPPALIITAELDPLCAEDERYAKRLAADGVAVTYRMFAGCSHAFTHFGPEPAAQEAWTLIQEKLQQAFNR

SEQ ID NO: 689 - DNA, 762 bp, Unknown
  Obtained from environmental sample
atgaagcgtcgtctggcggctctcgccgctgctgtgtccctgctcgccagcggcctggcggtcgccgccaccacggccacggccaccgccgccggggccgcgacccgcgacccggtcgtcctcgtcgccgggacgctctcgccggcggtgatcctcgagccgctcgccgcccggctgcgggccgacggctacaccgtccacatcttcgagctgcccaacctgggcaccacggacatccgggcctccgcccgggcgctgaacaccttcgccgacggcatccgggcccggtacggggcgtcgaaggtcgacctcatcggccactcccagggcggcctggtcgcccgcgcctacgtgaagtacgagggcggcgccaacgaggtcgacagcctcatcggcctcggctcgccgaactacggcacgtcgatcgccaacatcgtcgccttcctgggcctcgggaactgcatcgggatcgtggcgtgcaaccagatggcgatcgggtcgagcttcctgaacgacctgaacgcgggcgacgacaccatcggcaacgtccgctacacgaacatctacaccagcctcgacgagctggtccgcccggtcgagaacgccgccatgcgcgacggcgccaccaacgtccgggtgcagtcgcagtgctggctgcgggtggtcggccacctcggcctcatcctcgacggcaccgtgtacagcggcatccaggacgccctcgccggccgtcccgtcaccctcaactgctgggccctctag

SEQ ID NO: 690 - protein, 253 aa, Unknown
  Obtained from environmental sample
  SIGNAL (1)...(22)
  DOMAIN (36)...(238): Lipase (class 2)
MKRRLAALAAAVSLLASGLAVAATTATATAAGAATRDPVVLVAGTLSPAVILEPLAARLRADGYTVHIFELPNLGTTDIRASARALNTFADGIRARYGASKVDLIGHSQGGLVARAYVKYEGGANEVDSLIGLGSPNYGTSIANIVAFLGLGNCIGIVACNQMAIGSSFLNDLNAGDDTIGNVRYTNIYTSLDELVRPVENAAMRDGATNVRVQSQCWLRVVGHLGLILDGTVYSGIQDALAGRPVTLNCWAL

SEQ ID NO: 691 - DNA, 789 bp, Unknown
  Obtained from environmental sample
atgagcgtggaggctggcgcgatcgcgctgcaggggcgccgtgtcctcctggtctatggtctgatgggggaggtcgtcgccgcgttccgtccgctgggactcgaatacatgcaccccctggccgactggctgcaggccgagggcgcccacgccagggtggtgaagctgcggaccgcggaatcagtgtcgtccaacgcggcgcggctgcgcgcggaactcctcgccgagccggagcccgcgctggtcgtcgcccacagcaagggcgggctggaagcgctggcggcgctgctcgatcccgtggcgcaggcgcggtgcgtcggcttcctggccatgcaatcgcctttcttcggcagcccgatcgccgacctggtcgtgggtgcgaagccgctcgagacggccgcgggcggtctcgcccggctgctcggcatcggcaccgaggagggcgtgcgcgacctgacgacctcggcgcggcgggcctggatggcggcagcggaagcgcccatcgcgcggctgatcgccgccatgcccgtcgtctgcctggcgacggcgctgagcgaggggcaggcgagcgggcgggagaggctgcacctcgccgccgcgcaatggatggagaagcggggctatggccccaatgacgggctggtgccggtggacagcgcgctgatcccgggcgcccgccatgtggtgctgccgggcagccacatcgcgacggtcagccgcggcccggggcgtgacccggtggccctgatgcgggtggggctcgatgccctgtccgccgcgccggcctga

SEQ ID NO: 692 - protein, 262 aa, Unknown
  Obtained from environmental sample
MSVEAGAIALQGRRVLLVYGLMGEVVAAFRPLGLEYMHPLADWLQAEGAHARVVKLRTAESVSSNAARLRAELLAEPEPALVVAHSKGGLEALAALLDPVAQARCVGFLAMQSPFFGSPIADLVVGAKPLETAAGGLARLLGIGTEEGVRDLTTSARRAWMAAAEAPIARLIAAMPVVCLATALSEGQASGRERLHLAAAQWMEKRGYGPNDGLVPVDSALIPGARHVVLPGSHIATVSRGPGRDPVALMRVGLDALSAAPA

SEQ ID NO: 693 - DNA, 1152 bp, Unknown
  Obtained from environmental sample
atgacaacagttccagaacagcttgacgccaaagtcgctgacgcgcttgacccgatcattgatgcagcactcaccgaaggtcgattggcaggcggcgtcgcactggtggcaaagcgtggaaagttggtctatgcacgcgctgctggttttgccgatattgagagcaagcgtcccatgacccgagacgccatcttccttgcggcctcgctcaccaagccgattgtgacagccgcgttcctctcattggtcgaggacggcgtgatgagcatggatgagccgatcacaaaatacctccccgacttcacaccggcgtttgagggtaagacacagcagatcacgttgcgccaactactcactcatacgtctggtctttcctatggtttcctgcaaccggcagacggtccctatctgcgcctcggcgtttcggatgggttgaacgaaccgggtcggtcctttgctgacaacttggcgcggattgtcgaagccggtctgttctttccgccgggcggggcttggctctactcggtcagcatggatgtgttgggtgcggcgatggaagtggcgaccggcaagagcttgccgcaagtcgtaagcgagcgtgtgtccagcaagctcggcatggcagatagcgggtttgcaatcacggatcgcgcgaggctcgcaacaccttatgcagatggtccgccgccggtgcccatgggaaacgatttcgttttccccttcgccgaactttcaggcattcgcttcacgcccggccgcattttcgatcagacgtcgtttccatcgggcggcggcggcatggcgtgcagcgcgcctgatctgctgacctttctggaagccatccgcactggtggcgcaccgattgtgaaggctgagacagcaaaggcgatgatgaccaaccagactggctcgcacgccttgctactgaacggccccggttggggctttgggtatggtggcgcggtgttgctggacccgacgccaaccgcttcgcgcctgccagtgggcacatggacctggggtggtgtttacggtcacagctggtccgtcgatccaacaggagagacgagctgtgtcttgatgaccaacaccacggtcgaagggatggcgggtgcattgtctgtcgatttgatggctgcagcattggcatga

SEQ ID NO: 694 - protein, 383 aa, Unknown
  Obtained from environmental sample
  DOMAIN (16)...(383): Beta-lactamase
MTTVPEQLDAKVADALDPIIDAALTEGRLAGGVALVAKRGKLVYARAAGFADIESKRPMTRDAIFLAASLTKPIVTAAFLSLVEDGVMSMDEPITKYLPDFTPAFEGKTQQITLRQLLTHTSGLSYGFLQPADGPYLRLGVSDGLNEPGRSFADNLARIVEAGLFFPPGGAWLYSVSMDVLGAAMEVATGKSLPQVVSERVSSKLGMADSGFAITDRARLATPYADGPPPVPMGNDFVFPFAELSGIRFTPGRIFDQTSFPSGGGGMACSAPDLLTFLEAIRTGGAPIVKAETAKAMMTNQTGSHALLLNGPGWGFGYGGAVLLDPTPTASRLPVGTWTWGGVYGHSWSVDPTGETSCVLMTNTTVEGMAGALSVDLMAAALA

SEQ ID NO: 695 - DNA, 642 bp, Unknown
  Obtained from environmental sample
atgttacgcacactttacctgatcttggtattgatggggcttttcccattgtcctctacggttatggccgatacgcccaaaacttccactattttagtgtggggcgacagtttaagtgcggcttatggcatcccggtcgaaaaaggctgggtcaatttaatgcgaaccaagttaggcactgagtttaatgtcgtcaatggcagtattagtggagaaaccactgctggaggcttaagccgcttacctaaagcattaacagattatcaacctgattatgtattgatagaattaggggcgaatgatggtttgcatggtattgctaccgacatcatgaaagctaaccttagcaaaatgattgaactcagtcagaccaatcatgccaaggtggtattaattgggattcagctcccccccaatttcggtaatgcttttacggataagtttgatgccacttatacggatttagctaaacaatataacttgcctttagtgccatcattaatgaccaatgtggcagaaaattgggatttaattcaagctgatggtttgcacccaaccgcagaagcacagccattattgcttgaaaatgtatggaaggtggtagaaaccgttttaaaaccaactactcccgccaaatcataa

SEQ ID NO: 696 - protein, 213 aa, Unknown
  Obtained from environmental sample
  SIGNAL (1)...(23)
  DOMAIN (31)...(197): GDSL-like Lipase/Acylhydrolase
MLRTLYLILVLMGLFPLSSTVMADTPKTSTILVWGDSLSAAYGIPVEKGWVNLMRTKLGTEFNVVNGSISGETTAGGLSRLPKALTDYQPDYVLIELGANDGLHGIATDIMKANLSKMIELSQTNHAKVVLIGIQLPPNFGNAFTDKFDATYTDLAKQYNLPLVPSLMTNVAENWDLIQADGLHPTAEAQPLLLENVWKVVETVLKPTTPAKS

SEQ ID NO: 697 - DNA, 828 bp, Unknown
  Obtained from environmental sample
atggatagaaaaaaagtcggtttggcactttcgggcggcggggcgcgtggatttgctcatttgggcgttctgaaagttttggaggcgcataatattccgattgattttatcgccggaacttccgccggttcgatcgcgggtgcggcgttagcgagcggtttgaccgttgccgaaattatcgaaatgggtcgcaaagccagttggtataattttgtcggctttccgtattcaaccaagggattgctttcaaatgcgccgatgggagaattttacaaacgtcatctgccgataaaccgttttgaagacttaaaaattccctttgccgccgttgcctgcgatctggaaactggtgaagaagtcgtttttaaagaaaatggtgacttaataatggcgattcgcgccagttgtgcgattccgggcgtgttcgttccggttgaagacgaaacgggtaaaagatttattgacggcggggtggtcgcggcggttccgactaaagccgttcgcaaactcggcgcggaaatcattatcgctgttgatgttatttcttcgggcgcaaaatattggggaagcccgtccacactgctcggagttgtctttcaatcaatgatgatgctcctgcgcgccgcttcaaaagcgcatcattttcgcgctgatgtggttatcattccggcaatcgcccatcttcgccccgacgagatcggtaaaatggatgaatttatcaaagcaggtgaagaagccgcgctcgaaaagatcgatgaaataaaggctttgatcaatactgaaactttaaaaaacttaaaaaagatgcccgcggaaaacgcggaatga

SEQ ID NO: 698 - protein, 275 aa, Unknown
  Obtained from environmental sample
  DOMAIN (8)...(168): Patatin-like phospholipase
MDRKKVGLALSGGGARGFAHLGVLKVLEAHNIPIDFIAGTSAGSIAGAALASGLTVAEIIEMGRKASWYNFVGFPYSTKGLLSNAPMGEFYKRHLPINRFEDLKIPFAAVACDLETGEEVVFKENGDLIMAIRASCAIPGVFVPVEDETGKRFIDGGVVAAVPTKAVRKLGAEIIIAVDVISSGAKYWGSPSTLLGVVFQSMMMLLRAASKAHHFRADVVIIPAIAHLRPDEIGKMDEFIKAGEEAALEKIDEIKALINTETLKNLKKMPAENAE

SEQ ID NO: 699 - DNA, 969 bp, Unknown
  Obtained from environmental sample
atgacgcttccgcaccgacgttcgcacctgcgcccgattgatgagaggctctttgcccgctggctagcggccggcgccgtcgcaatgctgctcagtgtcactgcttgcgccgcgcaaccggcgaaaagcgagcgaccagcggccgctgacgtggttcgggtctggccgggggcggctcccggcacggagagttggaccggagcggaggtcgagctggacgccgatttgccggccggcaaagtccgggtcgtcaccaatgtcaccgcgccggcgctgacgatcgtgcgccccaagccgggcaccgccaacgggaccgcgatgctggttctacccggcggtgcattccgggcgctcgcctgggacctcgaaggaaccgaagccgcgcaacggctggccggccgcggcatcacggcctttgtcctcaaatatcgcgtccggcccccggtcggagcgcccgccgggccggaatctttcgacgccttcaccgttcgaacgcagccagcgagagacattgcggtcgccgacgcccggcaggcgcttcgcctgatccgggcacgggcgaaagactatggcatctcggccgatcggatcggaatgatcggcttttcagctggagccatggcggtaatggagctggcgctggcgcaagaggtgacggatcgcccgaacttcgcagcgtccatctatggagcggcgcccaccgagcggcaaccggccgccggcgccccgcccttgttccttgtggctgctcaggacgatccccaggtcccctccgaccgaagcgtcgatctgtatcgccgctggacccaagcgggcctgcccgccgagctgcacctctacgaaaagggcgggcacggcttcggcacgcgcgcccgcaacctccccgcggaccagtggcttgaagcgctcgaggcctggctcatctcccgccgcctggcgccaccacccgcagcggccaagcacaaataa

SEQ ID NO: 700 - protein, 322 aa, Unknown
  Obtained from environmental sample
  SIGNAL (1)...(37)
MTLPHRRSHLRPIDERLFARWLAAGAVAMLLSVTACAAQPAKSERPAAADVVRVWPGAAPGTESWTGAEVELDADLPAGKVRVVTNVTAPALTIVRPKPGTANGTAMLVLPGGAFRALAWDLEGTEAAQRLAGRGITAFVLKYRVRPPVGAPAGPESFDAFTVRTQPARDIAVADARQALRLIRARAKDYGISADRIGMIGFSAGAMAVMELALAQEVTDRPNFAASIYGAAPTERQPAAGAPPLFLVAAQDDPQVPSDRSVDLYRRWTQAGLPAELHLYEKGGHGFGTRARNLPADQWLEALEAWLISRRLAPPPAAAKHK

SEQ ID NO: 701 - DNA, 1446 bp, Unknown
  Obtained from environmental sample
atgaaactgacgctctatcctagagtggcgacggcggactgtttacgggtctgggccgcggcttttaatgcggtctccccgccggcgcttcattggaaactgaatggcaaggcgacggcgccctccgttgtccggccgatggaaagcgccttgcctccgaacatgctcgcaggaaaccgtccgcgcacgtttgcgggcgtttttgagttttccgggctcgatccggaccggcattacaacgtcgaatgcaaatcgaatggcgtgcgggaggaactcgagtcctggaccttgccgagccaggtgcccgaaggattgaataactggtttcacattctgctggtctcctgcttctatggtgcacaagacaagcgcggcctggccggattcgtcgcgaatgagatccggcaagcgatccggccgcatctgactctctttctgggcgaccaggtttatctcgacctgccgacactgcagaaccttcccaatgacatgatccggttggcggagaatttcgagacaaaatacgtcacgaattggggcagcccgctggggctggcccggctcctaaaggcggctccgtcggcatttctttccgacgatcacgagtattggaacaattttcctcatgccgcaaccgtcgtgcagcatagctggaccgaggaaggacgccgtcgttggaggcttccggccagccggctctatgaggcctttcaactatctgcgcccgcgaaatccggcgctgccgtcaccgtcgatgttccaccgctttcgatctttctggccgacacccgaacgttccgcgatccggactgccggcattccatgcagccgggtgcgttgaatcagctgcgcgcctgggtcgatcacatcctggccaggcagatgttcggcgtgtttgtcactggacagtcgatgttcgacccgccgaccagctggtttcaaggccggttcgtggaccgccacctggccgattacggagactatgcggcaatctcagtggaactcgagaagctgaccaaatcgggccggccggttctcttcctcacgggggacgttcactggggccgggttatggcgggacgcagtcaggtcacgggccgccctgttgcctatgaagtgatctcctcgcctgcatctctggtgtcggcgattggcgccgaccagcttgccactctgggaagcggcatcgccgggctgttcggcaagaagaacaaatggcccaggcacagcgatccgaagaaagctccggaacacttcaagctgaacgaaacggtctgccattttgaaacgctccaaagacagaagggaaaccacctggcgacgctttcgttcaaccgaatcggcgaatccctgctctcgatggtccgctactgggagatcgatccggatcgaggctataccggcccgaccaatccagttctcttccatctgcggcccgaaacttag

SEQ ID NO: 702 - protein, 481 aa, Unknown
  Obtained from environmental sample
MKLTLYPRVATADCLRVWAAAFNAVSPPALHWKLNGKATAPSVVRPMESALPPNMLAGNRPRTFAGVFEFSGLDPDRHYNVECKSNGVREELESWTLPSQVPEGLNNWFHILLVSCFYGAQDKRGLAGFVANEIRQAIRPHLTLFLGDQVYLDLPTLQNLPNDMIRLAENFETKYVTNWGSPLGLARLLKAAPSAFLSDDHEYWNNFPHAATVVQHSWTEEGRRRWRLPASRLYEAFQLSAPAKSGAAVTVDVPPLSIFLADTRTFRDPDCRHSMQPGALNQLRAWVDHILARQMFGVFVTGQSMFDPPTSWFQGRFVDRHLADYGDYAAISVELEKLTKSGRPVLFLTGDVHWGRVMAGRSQVTGRPVAYEVISSPASLVSAIGADQLATLGSGIAGLFGKKNKWPRHSDPKKAPEHFKLNETVCHFETLQRQKGNHLATLSFNRIGESLLSMVRYWEIDPDRGYTGPTNPVLFHLRPET

SEQ ID NO: 703 - DNA, 1800 bp, Unknown
  Obtained from environmental sample
atgagacaatatcgtccctttagggagattgcagcggcacttgtagttctatcttttgcagtcaatacactaccggtacctccggctgaggctgaagctgacggccgaagaaagataggccttgttcttggcggcggcggggcgctcggaggcgcccacctcggcgtcctgaaggtgctcgaagagaacaggatacccgtagattatatagctggcaccagcatgggctctattgtcggcggcgcgtacgcggcgggcatgtctccggatgaaattgaggaactcctcaattccatagactgggccaacctttttaatgacaaaccatcccgcgaccagataccgttccgcgacaagtatgatacaaggaggctggccaattttgaagtgggtgttggcaaagaagggctcaagatgccccatggggcggtggctggacagaagctcgattttattttacaggaggtgaccgtaaggacaggcgcggtagacgattttgacaaacttcatatcccctaccgggcggtcgcgaccgacatcgagacgggagagtcggttacgctcaagaagggcaaccttgcggaggccataagagccagcatgtcggtgccgggcgccttctctcctgtcgagatagacggacgcgtgcttgtggacggcatggtggccaagaacgtgccggtggatgtcgcgaaagagatgggcgccgaggagatcatatgcatagatgtcggcggcgcgcttcccggccgcgataagctcgactcaaatttggctatcatgatgcagatgatcggcatcttcaccaaacagaacgtagattatcagaaaggtctccttaccgacaaggatatctttatagaggcgaacccgggagcggagtttaccgcggtagattttacccggcttcaggagataatagacgctggtgagaagatagccagagggcatatagaagaattgaagagatattcggtctccgaagaggagtataaggagttcattgccaggcagcggggcgcgctcaaagacgtagagatagattttgtaaaagtaggctctaccggccgcgtggagccgaggctcgtcaagtcaaaggtaaagacgaaggccggaaaagagctggactttaagacattggaagacgatctctcgcgaatctactctataggcgatttcgagaatgtgaatttctcgatcgcggaagagaagggagagaagggtctgttgatcgaaggaaaagagaaatcgtgggggcctcactatctttcgttcggcgcaaacatattagaaaatttcaagggcgacagctattatacactccttgcccagcaccagtggaggcaggtaaacaggcttggagccgattggaaaaacaggttcgccatgggaaaggaacttggctaccagacgctcttctatcagccgctagactattctgaaaggttctttatacagcccatggcacgggtagggcaggagtatatcgatgtctacagcgaccatgagaagataacggaatacgaggtgcaggatatggccggcgccttcgaggggggcgtcaatttcggcaacgaggcccaggcccgcggcggtatgttctggcgcggtcttactgcggagccgaatatcaagcggtttggtataccggaatacaaagatctctatgagaccggcgtacacggcaactttacttacgacagcatgaatagcgccaattttcccagagaaggcatgctggcctttgcggatatatattctccgctggaagcgcttgactgtgacgaagaccataactag

SEQ ID NO: 704 - protein, 599 aa, Unknown
  Obtained from environmental sample
  SIGNAL (1)...(31)
  DOMAIN (41)...(232): Patatin-like phospholipase
MRQYRPFREIAAALVVLSFAVNTLPVPPAEAEADGRRKIGLVLGGGGALGGAHLGVLKVLEENRIPVDYIAGTSMGSIVGGAYAAGMSPDEIEELLNSIDWANLFNDKPSRDQIPFRDKYDTRRLANFEVGVGKEGLKMPHGAVAGQKLDFILQEVTVRTGAVDDFDKLHIPYRAVATDIETGESVTLKKGNLAEAIRASMSVPGAFSPVEIDGRVLVDGMVAKNVPVDVAKEMGAEEIICIDVGGALPGRDKLDSNLAIMMQMIGIFTKQNVDYQKGLLTDKDIFIEANPGAEFTAVDFTRLQEIIDAGEKIARGHIEELKRYSVSEEEYKEFIARQRGALKDVEIDFVKVGSTGRVEPRLVKSKVKTKAGKELDFKTLEDDLSRIYSIGDFENVNFSIAEEKGEKGLLIEGKEKSWGPHYLSFGANILENFKGDSYYTLLAQHQWRQVNRLGADWKNRFAMGKELGYQTLFYQPLDYSERFFIQPMARVGQEYIDVYSDHEKITEYEVQDMAGAFEGGVNFGNEAQARGGMFWRGLTAEPNIKRFGIPEYKDLYETGVHGNFTYDSMNSANFPREGMLAFADIYSPLEALDCDEDHN

SEQ ID NO: 705 - DNA, 870 bp, Unknown
  Obtained from environmental sample
ttgcaacagctaagattctccttgcttttaaatttgttcagattcggattcttcttttcacttcttactctgctgggggggtgctctcctctaaagctggtcaacggattgaccccaaacggtgcgcaagaggttgaacgcaacctctcttacggggtggaggtgagacagaaacttgatgtctaccggcctgccaagccggatgagggcagccccgtggtagtttttttctatggcgggagctggcgcagcggagaaagaggtaattatgagtttgtcggccagagtttaagctcgcgtggttttattacggtaatacccgattaccggctttaccccgaggtgcgatttcctgcgtttgttgaggacggtgcccgggccttggcatggatacacgaaaatgtcagtgaagcggaacacggcctcgtcttgatcggccactccgccggcgcccatctggccgcattgctggcgcttgatcagaagtacctgaatgcttttagactttccagttctcaggtcaagggattgataggactggcgggaccctatgcttttgatcctttgtcttacagaaaaacgcgaccaatattcagtggactgaatgatgcagataacgccaggccggtatcctatgcctgcaataacagcccgcccctccttctcctgcatggtcgtgaagatcgcctggtacttccgggcaattcgaggaaattgcatgaactgcatcaggaatgcggaatgaagtctaactttatcgagcttagcgatgtggggcatttcgacatagttcttggtctctcagattcattctcaaatctggcgccagtcctcgggccgatccagcatttcattcaggaatcaatatag

SEQ ID NO: 706 - protein, 289 aa, Unknown
  Obtained from environmental sample
MQQLRFSLLLNLFRFGFFFSLLTLLGGCSPLKLVNGLTPNGAQEVERNLSYGVEVRQKLDVYRPAKPDEGSPVVVFFYGGSWRSGERGNYEFVGQSLSSRGFITVIPDYRLYPEVRFPAFVEDGARALAWIHENVSEAEHGLVLIGHSAGAHLAALLALDQKYLNAFRLSSSQVKGLIGLAGPYAFDPLSYRKTRPIFSGLNDADNARPVSYACNNSPPLLLLHGREDRLVLPGNSRKLHELHQECGMKSNFIELSDVGHFDIVLGLSDSFSNLAPVLGPIQHFIQESI

SEQ ID NO: 707 - DNA, 726 bp, Unknown
  Obtained from environmental sample
atggagtataaacgattaaggttcaggcaatactttgccgatcagtcaaacgggcattatggcggctatccccgcatcaatgttccgtataaaaaggttgaatacacctgccgccacggtcacaagcacgatgcttattactatatgtggtatgaaaaggcaagagatgtaattcaaatttatttcaaagaaacatcatcaaaatcgcaatggagagcgaactttaacttcccagacagctactacgataggtttcagtttgatgggaaagatattcaattaaaggttgctcaaggatggatggacttatattgcgctttaaaacacattattagagatgaatataaggttctaattgatgcttatggtgagaaagaagttgagattatcgggtggtcactcggatccgcaatagctcaattatgcgcacaagacttattcttcaattatggggttaaatcacacttatttacttatggtagtgttaaaccttgggccggcaaagatccggatatgcgagaatatcttggcaaatgcacaaaagagtgctataacttctatgaccataatgatattgtaggttatttaccaccattccataactactttgcgatgaatcattacaaggttcaccaggacaagtttaatatcttcaggttatttaacccgcagaagtatcacactgaatactggaagcctgaactttataaggacatcgaagaataa

SEQ ID NO: 708 - protein, 241 aa, Unknown
  Obtained from environmental sample
  DOMAIN (55)...(201): Lipase (class 3)
MEYKRLRFRQYFADQSNGHYGGYPRINVPYKKVEYTCRHGHKHDAYYYMWYEKARDVIQIYFKETSSKSQWRANFNFPDSYYDRFQFDGKDIQLKVAQGWMDLYCALKHIIRDEYKVLIDAYGEKEVEIIGWSLGSAIAQLCAQDLFFNYGVKSHLFTYGSVKPWAGKDPDMREYLGKCTKECYNFYDHNDIVGYLPPFHNYFAMNHYKVHQDKFNIFRLFNPQKYHTEYWKPELYKDIEE

SEQ ID NO: 709 - DNA, 636 bp, Unknown
  Obtained from environmental sample
atgaataaactgacaaaaaagctttccatgctggtgttgtttgcatcgctgttgttcgccggggcagcgaaggcgtgcaatgcagatcccattgtcttcattcatggttattcaggctggaagtcccagtttaataccatgatcaaccgtttccagaatgacggtacgcccgcctgtgcgatgtaccaattcggctacaacagcctgggcaagagcaaccgtaccagcgcccaggagctgagcgcgttcgttaataacattcgccccaatcataactggcgcagagcgaatatcgtcgcgcactccaacggtggcctggtcgcacgctggtatcgggtttttgaggggggctcatgggcaaccaaccgtttggttactctcggcaccccccataaaggcacctcctgggcctatggctgcttcagccccgcctgctttgaaatgcgttacaactcgtctttcctgcaacagttgaatgggcgcggctgtgatgtgtccctgtggtcagcggttgatcagatcatcatccctcagacaaatgcccagtgcggcaccagccgccggacatcctttgtgggtcacctgacgctgttgacctcgcagggcgtctataacgatgtaagacgttacctgtaa

SEQ ID NO: 710 - protein, 211 aa, Unknown
  Obtained from environmental sample
  SIGNAL (1)...(25)
  DOMAIN (28)...(209): Lipase (class 2)
MNKLTKKLSMLVLFASLLFAGAAKACNADPIVFIHGYSGWKSQFNTMINRFQNDGTPACAMYQFGYNSLGKSNRTSAQELSAFVNNIRPNHNWRRANIVAHSNGGLVARWYRVFEGGSWATNRLVTLGTPHKGTSWAYGCFSPACFEMRYNSSFLQQLNGRGCDVSLWSAVDQIIIPQTNAQCGTSRRTSFVGHLTLLTSQGVYNDVRRYL

SEQ ID NO: 711 - DNA, 1689 bp, Unknown
  Obtained from environmental sample
atgggattgttcgattacaaaaaagccgacggcaaagcgttgtacagcgatgccatcgcgctgacgctgtattcctacacgccgaccgggcagcctttgcccggcaccggttgggcgccactgggcgcctcggccctgggttatcaaggcaagaccgacgcaaaagggacgttcttcggcgagaaggacggcttcaccagcgccgaggcggaagtgctcggcaaatacgacgccgccggcaagctgatcggtatcggcgtggcctttcgcggcaccggcgggctgagttacagcgacaccttcggcgacatgaaaaacaacctgctggccgccatcgggccggtagattacgccaagaactacgcgaagaacgccttcgacaacctgctcaaatccgtggccgcgtttgctacggcccatggcatcgccgccaaggacgtgctgatcagcggccacagcctcggcggcctcggggtcaacagcgtggcggagctgagcgcgagcgactggggcgggttcttcaaggacgccaactacatttccttcgcctcgccgacccagagcagcaccggcaccaacgtgctgaacatcggcttcgagaacgatccggtgttccgtgtgctcgacggcaccacgttcagcacggcgtcgatgggcaaacacgacaagccgcacgactcgaccactgacaacatcgtcaacttcaacgaaaactacgcctctaccgcgcagaacctggtgccgttcagcatcgtcaacccgctgaactggtcggcccacagctcgctgggctatgccgatggtctgaaccgggtgatcgactcgaagttctataacctcaccagccaggactcgaccattatcgtgtccaatctggaagcctcgtcccggggcaagacctgggtcgaagatctgggccgcagcggcgagccgcataccggcagcaccttcatcatcggcaccgacagcaacgactggctcaagggcggggcgggcaacgacttcctcgaaggtcgtgccggcgatgacctgttccgcgatgacgggggcttcaacatcctgctcggtggtcagggccacaacaccttcgacctgcagaagccgttgcagaacttcagcttcgccaacgacggcgacggcacgctgtacgtgcgcgacgcctacggcggcatcagcgtgacccgcgacatcggcgcaatcgtgagcaaagagtccggttcgatgtggagcagcaaggaaatcacctggaccgtcaccgccaaaggcctggccaacggcgccgaactgacccagtacaaccattcgctcaacggcggcgcactcggcgacacgttgaaagccaccgctgacggcgactggctgttcggcctgggcggcgacgatcacctggtcagcgacaaggcccacgtgaccttcgtcggcggcgccggcaatgacgtgatgaatgcggtgggtggaaacaacaccttcctgttcagcggcgccttcggcttcgactcgatcaatggctaccagggcagcgacaaactggtgttcatgggcgtgcagggcgcggggcagggctacgactacaagcaacatgcttcgcagtccggcgccgataccgtgctgaagattggcgactatgccgtaaccctgatcggggtgggtgtggctaacctgtcggactcgagtttcgtgttcgcttga

SEQ ID NO: 712 - protein, 562 aa, Unknown
  Obtained from environmental sample
  DOMAIN (82)...(212): Lipase (class 3)
  DOMAIN (328)...(345): Hemolysin-type calcium-binding repeat (2 copies)
MGLFDYKKADGKALYSDAIALTLYSYTPTGQPLPGTGWAPLGASALGYQGKTDAKGTFFGEKDGFTSAEAEVLGKYDAAGKLIGIGVAFRGTGGLSYSDTFGDMKNNLLAAIGPVDYAKNYAKNAFDNLLKSVAAFATAHGIAAKDVLISGHSLGGLGVNSVAELSASDWGGFFKDANYISFASPTQSSTGTNVLNIGFENDPVFRVLDGTTFSTASMGKHDKPHDSTTDNIVNFNENYASTAQNLVPFSIVNPLNWSAHSSLGYADGLNRVIDSKFYNLTSQDSTIIVSNLEASSRGKTWVEDLGRSGEPHTGSTFIIGTDSNDWLKGGAGNDFLEGRAGDDLFRDDGGFNILLGGQGHNTFDLQKPLQNFSFANDGDGTLYVRDAYGGISVTRDIGAIVSKESGSMWSSKEITWTVTAKGLANGAELTQYNHSLNGGALGDTLKATADGDWLFGLGGDDHLVSDKAHVTFVGGAGNDVMNAVGGNNTFLFSGAFGFDSINGYQGSDKLVFMGVQGAGQGYDYKQHASQSGADTVLKIGDYAVTLIGVGVANLSDSSFVFA

SEQ ID NO: 713 - DNA, 771 bp, Unknown
  Obtained from environmental sample
atgatattcaaggccaagtttggggagcccaaaagaggatgggtagtgatagtgcacggcctgggagagcacagtgggaggtacgcgaagctcgttgagatgctagttgagaggggctttgcggtatatacattcgactggcctgggcatggaaagagttcagggaagagaggacacacaagtgttgaggaggcaatggagataattgacgaaattattgaggagatcggggaaaagccgttcctatttgggcacagcctaggcgggctaactgtcataaggtacgcagaaacaagggctgagaaggtgaggggagttattgcctcctcgccagctctagcaaagagcccaaacaccccaggattcctagttgcgttggcgaagttcttaggtgtggtggctccaggaattacgttttctaatgggatcaacccaagcttactctcaaggaacaaagatgcagtgaggaggtacgtagaggatcccttagttcacgacaaaatcacggcaaagcttggaaggagcatattcataaacatggagcttgcccatagggaggccgagaaaatcaaagtgccaatcctgctcttagtaggaacccaagacgtcataacgccccccgaaggagccagaaaattgtttgagaaacttaaagtcgaagacaaagagattagagaattcgagggagcttaccatgagatatttgaggatccggagtggggagaagaattccatagggtgatagtggagtggctggagaagcacagttaa

SEQ ID NO: 714 - protein, 256 aa, Unknown
  Obtained from environmental sample
  DOMAIN (40)...(250): alpha/beta hydrolase fold
MIFKAKFGEPKRGWVVIVHGLGEHSGRYAKLVEMLVERGFAVYTFDWPGHGKSSGKRGHTSVEEAMEIIDEIIEEIGEKPFLFGHSLGGLTVIRYAETRAEKVRGVIASSPALAKSPNTPGFLVALAKFLGVVAPGITFSNGINPSLLSRNKDAVRRYVEDPLVHDKITAKLGRSIFINMELAHREAEKIKVPILLLVGTQDVITPPEGARKLFEKLKVEDKEIREFEGAYHEIFEDPEWGEEFHRVIVEWLEKHS

SEQ ID NO: 715 - DNA, 603 bp, Unknown
  Obtained from environmental sample
atgaataacaagagcttcatcacaatccatggcattcgtaagtttggctcttctcccactcacatgcgccctataaacgaatcactcctctctagtaatctgaggacaatcccagtcaattatggctacaccctgctcccaatcacgaacagaaagagtgtttctagggcaattcctgtgctagaaaacgagctaaagcgagggagggacatcacccttatcgggtattctaacggcgcttggacagctctacagcttgcggaaatggcttatccaatccaacgtctagtgctcatctctcctgctcttcactctgctcacgccttccctcaaatcccttctcttgagcgtgtagacgtgttctattgccctacagataatgttggtgatcttgccaagacttggaggggagttactagaatcatgccttggagatggttctctccacacccttacggaagaatgatgaaaactggatttattggagaggatgaacgtgtctttaaccacaggcttggcgatcatgtaggccatgctttctacaaccatgctgatgctgtttcacacattatagaggtgattaaatatgaaactccttattag

SEQ ID NO: 716 - protein, 200 aa, Unknown
  Obtained from environmental sample
MNNKSFITIHGIRKFGSSPTHMRPINESLLSSNLRTIPVNYGYTLLPITNRKSVSRAIPVLENELKRGRDITLIGYSNGAWTALQLAEMAYPIQRLVLISPALHSAHAFPQIPSLERVDVFYCPTDNVGDLAKTWRGVTRIMPWRWFSPHPYGRMMKTGFIGEDERVFNHRLGDHVGHAFYNHADAVSHIIEVIKYETPY

SEQ ID NO: 717 - DNA, 717 bp, Unknown
  Obtained from environmental sample
atgatcttcccgcgtatgttcacgattcgtgtggtgtccatcgcggcggcgctggtgatcgccatcggctgcggcccggccgaacaggcgcaacggccgggggctcgggagctcgttccgccgacggccgcaccggaacggcaaccggatcgccccaggatcgtgttccttggagacagcttgagcgctggctacggactcgcacggcacgaatcggtgccggcgctgctgcaggcccggctggacgccgccgggtacgactacgaggtcgtgaatgccggcgtgtcgggcgacacctcggctggcggtctgagccggctcgactgggcgctggagggtccggtggacgtgctcgtcctcgaactgggcgccaatgacgggctgcgtgggctgccggtcgccaacatgaaacggaacctcgaagcgatcatcgtccgcgcggcccaacgggacatcaccgtggtgctcgccggcatggaggctccgccgaactacggcgaggcgtacacgtcggagttccggcaggcgttccacgatctggcgcgggcgcacgacctggcgttcatgccgttctttctggaaggggtggccggcgatccgcgcctgaatctggccgacggcatccatcccaatgcggccggcgcccgggtcgtcgagcgcaacgtctgggcggttctcgaaccgttgctcgcccaggacgacgagtcggcgcgatga

SEQ ID NO: 718 - protein, 238 aa, Unknown
  Obtained from environmental sample
  SIGNAL (1)...(29)
  DOMAIN (54)...(222): GDSL-like Lipase/Acylhydrolase
MIFPRMFTIRVVSIAAALVIAIGCGPAEQAQRPGARELVPPTAAPERQPDRPRIVFLGDSLSAGYGLARHESVPALLQARLDAAGYDYEVVNAGVSGDTSAGGLSRLDWALEGPVDVLVLELGANDGLRGLPVANMKRNLEAIIVRAAQRDITVVLAGMEAPPNYGEAYTSEFRQAFHDLARAHDLAFMPFFLEGVAGDPRLNLADGIHPNAAGARVVERNVWAVLEPLLAQDDESAR

SEQ ID NO: 719 - DNA, 1575 bp, Unknown; identical to SEQ ID NO: 109
  Obtained from environmental sample

SEQ ID NO: 720 - protein, 524 aa, Unknown; identical to SEQ ID NO: 110
  Obtained from environmental sample
  SIGNAL (1)...(20)
  DOMAIN (34)...(520): X-Pro dipeptidyl-peptidase (S15 family)

SEQ ID NO: 721 - DNA, 765 bp, Unknown
  Obtained from environmental sample
atgaaccaatctaaattcccaacagaagtaacactgtgcctctctggaggtgcagcacgtggagtgtaccaacttggtgctatttctgttctgcaagagcataatgtaaagataaaggcaatcagcggaacaagtataggtgcgcttataggtgctgcgctagggtgtcaaaaaagtgctgatgaaatctttgatatcatcagctctaaagagtttaaaagtgtgttcaagccgagttttggtaaaggctacttttttagacttgatgatagtgcaaaggtaattgacaagctcattgacagagcttcttttgaagagttgagcatccctttgacactctgtgtatgtgatgttaaagatgagtcggcaaaatattacaacagtggagtagacttcaaaaagctggtattggcatcatgctctattgcccctctttttaagcctgtggaattatatggcaggacttttgtcgatggcggtgtagtagataattttccagtggaacaattacaaagatatgactatccaatcataggaattaatttgcatccaaaatatagaaaaactccaagttctgtatttggctggttgaaaaaaaatatacatacggcttggcaaagccagtactatagaaaaagtaatctttgcgacatctacttgtgtaatgaagaactcaacaacgtaaaaatattctcttttaaagatttgcaaaaagcatatggattgggaaaaaaagatatgcacaatattatgcaagaggtttaa

SEQ ID NO: 722 - protein, 254 aa, Unknown
  Obtained from environmental sample
  DOMAIN (12)...(171): Patatin-like phospholipase
MNQSKFPTEVTLCLSGGAARGVYQLGAISVLQEHNVKIKAISGTSIGALIGAALGCQKSADEIFDIISSKEFKSVFKPSFGKGYFFRLDDSAKVIDKLIDRASFEELSIPLTLCVCDVKDESAKYYNSGVDFKKLVLASCSIAPLFKPVELYGRTFVDGGVVDNFPVEQLQRYDYPIIGINLHPKYRKTPSSVFGWLKKNIHTAWQSQYYRKSNLCDIYLCNEELNNVKIFSFKDLQKAYGLGKKDMHNIMQEV

SEQ ID NO: 723 - DNA, 936 bp, Unknown
  Obtained from environmental sample
gtgccggtcgacccgcacaccgccgccctgctcgccgtgctcgacgagtccggcgcgccgcccatgtacgaggggagccccgaggcggggcgcgccctgtacctgcagctcacccacggcgcccggacccccgagcagatcgtccctgtggcgagcaccgaggaccgcaccgtccccggcgccgagggcgaactccgggcgcgggtctaccggcccgagggcgaggggcccttcccgaccgtcgtcttcttccacggcggcggctgggtgatcggcgacctggacacccacgacaacatggcccgcaacgtctgccgggggtcccgcgccgtggtcgtcgcggtcgactaccgcctggcccctgagcacccgttccccgctgcggccgaggacgcggtggtcgcggcccgctgggtggcccagcacctggacgagttgggcggggacgaccggctcgcggtcgccggcgacagtgccggcggcaacctcgccgcggtggtggcccagcagctcaccgccgacggcaccccgctggccggacagttcctcatctaccccgccgtcgacgccgagggcgagtacccctcccgcgtgcagaacgccaagggctacttcctcgagaaggacacgatggactggttctacggccactacgccggagcctgggaggacgcgaaggacgcccggttgtccccgctgcacggcgccgacctctccggcctgcccccggcggtcatcgtcactgccgagtacgacccgctgcgcgacgagggcgaggcctacggcgacgcgctggaggccgccggggtccatgccgacgtacggcgatacgacggcctgatccacggcttcttcgacatggggacggtctcgcccacggcccaggccgccatcgacgagagctgcgcgcgcttcggggccctcatccggaagtga

SEQ ID NO: 724 - protein, 311 aa, Unknown
  Obtained from environmental sample
MPVDPHTAALLAVLDESGAPPMYEGSPEAGRALYLQLTHGARTPEQIVPVASTEDRTVPGAEGELRARVYRPEGEGPFPTVVFFHGGGWVIGDLDTHDNMARNVCRGSRAVVVAVDYRLAPEHPFPAAAEDAVVAARWVAQHLDELGGDDRLAVAGDSAGGNLAAVVAQQLTADGTPLAGQFLIYPAVDAEGEYPSRVQNAKGYFLEKDTMDWFYGHYAGAWEDAKDARLSPLHGADLSGLPPAVIVTAEYDPLRDEGEAYGDALEAAGVHADVRRYDGLIHGFFDMGTVSPTAQAAIDESCARFGALIRK

SEQ ID NO: 725 - DNA, 1263 bp, Unknown
  Obtained from environmental sample
atgcggacgacaactacaaattggagacaaatcgtgaaaagcctgaagctcttcctgatgggcctttgcctgttcatttccgcttcattcgcatcatctgcctatgcactgggcagttacacctacacgtacctgcgctgtttctatcgcgtcgatacatccccgctgaagcccaagaccacctacgtctggggcatcgatccgggcagcggcggctactaccgcatctatggccgctggtggaaagacggcttgctgagctgggaaaacatgttctacagcgacgtgtcgcaagatacgctgaaatcggtttgccagagcacgctcgccggctacggcatcaaccgcagcgtcgcactctcggcggcggccgatacgtcgctctcgctcaattacacggtgtggaccaacgacagcgcatcgcagggctcacgcatcaacaaaatcgtcgcattcggcgacagcctgtcggacaaccagaatctgtacaacgcgacccaatggcaactgccgaaccgcaacagttggtttctcggccgcttctcgaatgacaggaactggatcgaatacctgtcgagcaacgtgaatctgccgatgtacaactgggcagtggcgggcgcggcggcggatcagtactacgtcatcccgggtgtgtcgcaacaggtcgactcgtggatcacctacatgcagagcgcgccgaattaccaggccgcgaatacgctgttcaccgtgcttgtcggcggcaacgatctggtgaactacggccggtctgtcgactcgatcatctccgcggagcagcaggcgctggtgaagatgatcaatgccggcgctcgcaacatcctgttgctgaatctgcccgacgtatcgcgcgcaccggtattccagtatcgcagcgacgccgccaccatcgccgcgcaagtccgcgacttcaaccagaagctggcgcaactgcgcgacaatcttcaggcgacgtacggcccgtcgctcgtcattcgcatgttcgatacctacaccttgttcaacgatctgctgaacaatccgaccaactatggcgtgacgaacacctggcagtcctgcctcgacatcaactcggattccgggtcgaactatctttatacctggccgacgcgcgccgaatgcaccaacgccgacagcttcgtgttctgggacacgctgcacccgaccacgcatacgcacaagctgctgggcgacaatgcggcgaatttcgtacgcgccggtttccccgcattgtctgcgccttga

SEQ ID NO: 726 - protein, 420 aa, Unknown
  Obtained from environmental sample
  SIGNAL (1)...(36)
  DOMAIN (149)...(406): GDSL-like Lipase/Acylhydrolase
MRTTTTNWRQIVKSLKLFLMGLCLFISASFASSAYALGSYTYTYLRCFYRVDTSPLKPKTTYVWGIDPGSGGYYRIYGRWWKDGLLSWENMFYSDVSQDTLKSVCQSTLAGYGINRSVALSAAADTSLSLNYTVWTNDSASQGSRINKIVAFGDSLSDNQNLYNATQWQLPNRNSWFLGRFSNDRNWIEYLSSNVNLPMYNWAVAGAAADQYYVIPGVSQQVDSWITYMQSAPNYQAANTLFTVLVGGNDLVNYGRSVDSIISAEQQALVKMINAGARNILLLNLPDVSRAPVFQYRSDAATIAAQVRDFNQKLAQLRDNLQATYGPSLVIRMFDTYTLFNDLLNNPTNYGVTNTWQSCLDINSDSGSNYLYTWPTRAECTNADSFVFWDTLHPTTHTHKLLGDNAANFVRAGFPALSAP

SEQ ID NO: 727 - DNA, 948 bp, Unknown
  Obtained from environmental sample
atgagtcttcatcctcaagcaaaagctttgcttgcggtgcttgaatcgagcccgcctatcgaacagcaaaccgttgaagaagccaggcaagcatatgcgaaaatgtgcagttattttaataaacgtgaagatgtttatagagtagaagacaggcaaataaaaggattccagcagaatatttcgatacgcatctataccccagacgataaagccattcatccggcgctcgtttattttcatggcggcggctgggttatcggcgacttggaaacccatgatgccctttgccgttctttggcaaataaatctggagcggctgttgtttcagtggattatagcctttcacccgaatatagatttccagttgccatcgaagattcgtatctggcagttaaatgggtggcagatcatgcagaagagcttggaatcgacaaaaccatgattgccgttggcggtgacagtgcaggcggtaatctcgcgactgtcgtttgccatttagcgaatcaaagaaaagcccctgccatcagctatcaaatgctgttttacccttcaaccggatatgagcgaacaccgtctatcgataaatatggtgaaggttatcatcttacgaattcaacaatgaagtggtttcaacaacaatacttatcccaacctgaagacctgcgtaaccccttggccgcccctatgttactgtcagaatctgaaattgccttattaccgccagcttatgtcttaactgccgaatatgaccccctatgtgatggcggagaaatgtacgccaaaaaattggaacatgcgggagtagaagtaacatacgtctgctacccgggaatgatccatggcttcctgacgatgtcggagccgttggatgattgcaagcgagcgattaatgaagcggcacaaaacttgaaagcccattttacaaagacagttgccgtaaacgagtaa

SEQ ID NO: 728 - protein, 315 aa, Unknown
  Obtained from environmental sample
MSLHPQAKALLAVLESSPPIEQQTVEEARQAYAKMCSYFNKREDVYRVEDRQIKGFQQNISIRIYTPDDKAIHPALVYFHGGGWVIGDLETHDALCRSLANKSGAAVVSVDYSLSPEYRFPVAIEDSYLAVKWVADHAEELGIDKTMIAVGGDSAGGNLATVVCHLANQRKAPAISYQMLFYPSTGYERTPSIDKYGEGYHLTNSTMKWFQQQYLSQPEDLRNPLAAPMLLSESEIALLPPAYVLTAEYDPLCDGGEMYAKKLEHAGVEVTYVCYPGMIHGFLTMSEPLDDCKRAINEAAQNLKAHFTKTVAVNE

SEQ ID NO: 729 - DNA, 1350 bp, Unknown
  Obtained from environmental sample
atggcaacaacaatgcgcggagcaagcaagctcctggctggcatgaccctggcaatatcggccttgacggcaaccggcgaggctttcgccgccaacaatctgccgattgtgctggtacacggcttcctcggcttcggcccgaacgaaatgcaaggcaccggcttcaaatactggggcggtttcaacgatgtacaggcctacctcaaaaccaacaatggcagccaccaggtgcatgccgccgcggttggcccggtcagctcgaactgggatcgtgcggtcgagttgttctaccagatcaagggcggctgtgccgactacggtgccgcacgtaccgcccgctttgccgcgttcggcaagatccagaaaccggccggcaaatgctgggcgaccgatccgaacaacaacccgaacaactacccgctggcgctgtacccgcaatgggatgccgcacatccgatccatctggtgtcgcacagccagggcggccagaccatccgcacaatgatccagttgctggaaaacggctcgccttatggcaatgaaggtggcggcgccttgtataccggcggcaagatcggctgggtgaaaagtgccaccaccatttccactccgcacaacggcaccacgctgcgcgacgtgatcatcgactacgtgccgaaagtgtccgagctggccgggaaggcggttgaagtggccggtctgggcggcagcagcggccggatctacaacttcaagctggagcaattcggcctggcacaaggtccgtcggaaaacttccaggatttcatcaaccgcaccaagggcgcagcattctggaaactggaaaaccacgattcggcacagtgggatctgggcccggacggcgccaaagagctgaacagctgggtcaagacctcgccgaacgtgtattactactcgatcgccaaccatgccaccgaacagggcagcttctgctgcaatgaaaccgaccggctgatcgcgccgatccagagcagtgcctaccagtacgcccgcaacgacatgatcttcttcctcaagaacaccgctggcgaatgggttgtgccatcgatcctgcaggaaggcatgggctcctacacccagaccgacccgagccgggtactgatcgacagcaactggttcgtcagcgatggcgtggtcaactacatcagcatgaaatcgccgtcgggccagccggtacgcacctacaacggtacatcggtcaagggttactggaaccacctcggttattacaacaactacgaccacttcgacgtgatcggctggctgaactccagctcgaccgtctacccgatctacaactacctgaccggcattctctacggtctgtaa

SEQ ID NO: 730 - protein, 449 aa, Unknown
  Obtained from environmental sample
  SIGNAL (1)...(30)
MATTMRGASKLLAGMTLAISALTATGEAFAANNLPIVLVHGFLGFGPNEMQGTGFKYWGGFNDVQAYLKTNNGSHQVHAAAVGPVSSNWDRAVELFYQIKGGCADYGAARTARFAAFGKIQKPAGKCWATDPNNNPNNYPLALYPQWDAAHPIHLVSHSQGGQTIRTMIQLLENGSPYGNEGGGALYTGGKIGWVKSATTISTPHNGTTLRDVIIDYVPKVSELAGKAVEVAGLGGSSGRIYNFKLEQFGLAQGPSENFQDFINRTKGAAFWKLENHDSAQWDLGPDGAKELNSWVKTSPNVYYYSIANHATEQGSFCCNETDRLIAPIQSSAYQYARNDMIFFLKNTAGEWVVPSILQEGMGSYTQTDPSRVLIDSNWFVSDGVVNYISMKSPSGQPVRTYNGTSVKGYWNHLGYYNNYDHFDVIGWLNSSSTVYPIYNYLTGILYGL

SEQ ID NO: 731 - DNA, 1854 bp, Unknown
  Obtained from environmental sample
atgggtgtgtatgactacaagaatttcggtacggcggaatccaaggcgctgttcagcgacgccatggccattacgctgtattcctaccacaacctcgataacggctttgccgtcggttatcagcacaacggcttcggtctcggcctgccggccacgctggtgaccgcgctgatcggcggcacggattcccaaggcgtgatccccggcattccgtggaaccccgattcggaaaaagctgcactcgacgcggtgaaaaaagccggctggaccccgatcaccgcctcgcaactgggttacgagggcaagaccgatgagcgcggcaccttcttcggcgaaaaagccggctacaccagcgctcaggtggaaatcctcggcaaatacgacgctcagggccatctgacggaaatcggcatcgcctttcgcggcaccagcggcccacgggaaatcctgatcggcgactccatcggtgacgtgatcaacgacttgctcgccgcattcggacccaaggattacgccaagaactatgtcggcgaagcctttggcaacctgatgaacgatgtggtggccttcgccaaggccaacggcctgaccggcaaggacgtgctggtcagcggccacagcctcggcgggctggcggtcaacagcatggcggacttgagcaccagcaaatggggcgggttcttccaggattccaactacatcgcctatgcctccccaacccagagcagcaccgacaaggtgctcaacgtcggctacgaaaacgatccggtgttccgcgccctcgacggctcaaccttcaccggcgcctcgctcggcgtgcacgacgcgcccaaggagtcggcgaccgacaatatcgtcagcttcaacgaccactacgcctcggcggcgtggaacgtgctgccgttctcgatcgtcaacattccgacctggatctcgcacctgccgaccgcttatggcgacggcatgaaccgggtgatcgagtcgaagttctacgacctgaccagcaaggactcgacgatcatcgtcgccaacctgtcggatccggcgcgggccaacacttgggtgcaggacctgaaccgcaacgccgaaacccacaagggcagcacgttcatcatcggcagcgacgccaatgacctgatccagggcggcagcggcaacgattatctggagggccgcgccggcaacgacacgttccgtgacggcgggggctacaacatcctgctcggcggttcgggcaacaacactctggagttgcagaagtcggtcaatactttcgacttcgccaacgacggcgccggcaacctgtacatccgcgatgccaacggcgggatcagcatcacccgcgacatcggcagcatcgtcaccaaggaaccgggcttcctctggggcctgttcaaggacgacgtgacccacagcgtcacggcgaccggtcttaaggtcggcaacaacgtcacccagtacgaatcgagcgtgaagggcaccggcggcgccgacaccctcaaggccaaggccagcggtgactggctgttcggcctggaaggcaacgaccacctgatcggcggggcgggcaacgacgtattcgtcggcggcgccggcaatgatctgatggagtcgggcggcggggcggataccttcctgttcagcggcgcgttcggccaggatcgcgtggtgggttacaccgccaacgacaaactggtgttcctcggcgtgcagggcgtattgcccaacgacgacttccgcgcccatgccacggcggtggggcaggatacggtgctgaagttcggcgcggattcggtaacgctggtcggggttgcgttgaacagcctgagtgccgacgggatcgtgatcgcctga

SEQ ID NO: 732 - protein, 617 aa, Unknown
  Obtained from environmental sample
  DOMAIN (133)...(265): Lipase (class 3)
  DOMAIN (381)...(398): Hemolysin-type calcium-binding repeat (2 copies)
  DOMAIN (510)...(527): Hemolysin-type calcium-binding repeat (2 copies)
MGVYDYKNFGTAESKALFSDAMAITLYSYHNLDNGFAVGYQHNGFGLGLPATLVTALIGGTDSQGVIPGIPWNPDSEKAALDAVKKAGWTPITASQLGYEGKTDERGTFFGEKAGYTSAQVEILGKYDAQGHLTEIGIAFRGTSGPREILIGDSIGDVINDLLAAFGPKDYAKNYVGEAFGNLMNDVVAFAKANGLTGKDVLVSGHSLGGLAVNSMADLSTSKWGGFFQDSNYIAYASPTQSSTDKVLNVGYENDPVFRALDGSTFTGASLGVHDAPKESATDNIVSFNDHYASAAWNVLPFSIVNIPTWISHLPTAYGDGMNRVIESKFYDLTSKDSTIIVANLSDPARANTWVQDLNRNAETHKGSTFIIGSDANDLIQGGSGNDYLEGRAGNDTFRDGGGYNILLGGSGNNTLELQKSVNTFDFANDGAGNLYIRDANGGISITRDIGSIVTKEPGFLWGLFKDDVTHSVTATGLKVGNNVTQYESSVKGTGGADTLKAKASGDWLFGLEGNDHLIGGAGNDVFVGGAGNDLMESGGGADTFLFSGAFGQDRVVGYTANDKLVFLGVQGVLPNDDFRAHATAVGQDTVLKFGADSVTLVGVALNSLSADGIVIA

SEQ ID NO: 733 - DNA, 933 bp, Unknown
  Obtained from environmental sample
atgaaaaaaatactgataacaaagctgatggctattctgtttgccatctgcgccctgccagcccagacatgggcagcagggtatacggagacaaaatatcccattgtgttagtccacggtttattcggatttgacaacatcggcccggttgactactggtacggtattccatcggcactacgctcagacggcgcacgcgtgtatgtcacgcaagttgcagcggccaacagcacagaagtccgtggtgaacaattgctgacgcaggttaagcagattcttgcagtcaccggtgccagcaaagtgaatctgatcggtcacagccacggcggaccaacgatacgctatgtggcctcggtcaggccagatttggttgcgtcggtcacctcagtcggtggtgtgaaccggggctccgcggtggcagatatcattctgggcatcgcgccgccgggttccatcaccaacagcgtgcttgtctcggtaactaacggactggcaacaatcatcagtttcctgtcgggccagccaaatttatcgcaagatgcgctggcagcggcaaactccctcagcaccgctggttcgctcaaattcaacagcaaacatccgcaaggagtaccgaccactgcttgcggtgaaggcgcatataacgtcaacaacgttgcttactactcgtggagcggagcaaaaccgtacaccaatgttcttgatgtcgttgatccggccctctcactgacctcgctggcctttggcggcagcaaaaacgacggactggtcagcagttgttcctcccatctcggtaaggttattcgcgatgactacgcgatgaatcatcttgacgaagtgaatcagaccataggcctggtcaatatttttgaaacgaatccggtgacgatataccggcagcatgcaaatcgtctgaaaaatagcggcttgtaa

SEQ ID NO: 734 - protein, 310 aa, Unknown
  Obtained from environmental sample
  SIGNAL (1)...(25)
  DOMAIN (44)...(286): alpha/beta hydrolase fold
MKKILITKLMAILFAICALPAQTWAAGYTETKYPIVLVHGLFGFDNIGPVDYWYGIPSALRSDGARVYVTQVAAANSTEVRGEQLLTQVKQILAVTGASKVNLIGHSHGGPTIRYVASVRPDLVASVTSVGGVNRGSAVADIILGIAPPGSITNSVLVSVTNGLATIISFLSGQPNLSQDALAAANSLSTAGSLKFNSKHPQGVPTTACGEGAYNVNNVAYYSWSGAKPYTNVLDVVDPALSLTSLAFGGSKNDGLVSSCSSHLGKVIRDDYAMNHLDEVNQTIGLVNIFETNPVTIYRQHANRLKNSGL

SEQ ID NO: 735 - DNA, 1425 bp, Unknown
  Obtained from environmental sample
atgggtatctttgactataaaaacctcggtaccgaggactccaaggcgttgttcgccgatgccatggcgatcacgctgtattcctaccacaacctggataacggctttgccgtcggctaccagaacaatggcctcgggctggggttaccggccaccctggtcagcgccctgattggcggcagcaatgcccaaggggtcatccccgggatcccctggaaccccgactcggaaaaagccgcccttgaggcggtgcaagcagccggctggacgcccatcagcgccagtaccctgggctatagcggcaaggtcgatgcgcgcggcaccttctttggcgaaaaattcggctacggcacggcgcaggccgaggtgctgggcaagtacgatgacgctggcaagctgctggaaatcggcatcagtttccgcggcacttcagggcctcgggaaagcgtgatcactgactccatcggcgatgtgatcagcgacctgctcgccgccttcgggcccaaggattatgccaagaactacgcgggggaagcctttggcggcttgctcaagaacgtggcggacttcgccagcgcccagggcctgggcggcaatgacgtagtggtcagcggccacagtctgggcggcctggcggtcaacagcatggccgacttgagcgacagtacctggtcggggttctataaagacgccaattacgtggcctacgcatcgccgacccagagcgccggcgacaaggtgcttaacgtcggttatgaaaacgatccagtattccgagccctggatggctcgtcattcaacctgtcgtccctaggcgtgcacgacaaggcccacgaatcgagcaccgacaacattgtcagtttcaacgatcactacgcctcatccctgtggaacgtcctgccgttttccatcctcaacctgcccacttgggtttcgcacttgcccaccggttacggtgacggcatgacccgtatcctcgactcggggttctacgaacagatgacccgcgactccacggtgatcgtcgccaacctgtccgacccggcacgggccaccacctgggtgcaagacctcaaccgcaatgccgaggcgcacaagggcaataccttcatcatcggcagcgacggcgacgacttgatcaaaggcggcaggggcgcggactttatcgaaggtggcaagggcaatgacaccatccgcgacagcagtgggcacaacacgtttttgttcagcgggcagtttggcaatgaccgggtgatcggctaccaggcgacggacaagctggtgttcaacgacgtggcgggcagcaatgattaccgcgatcacatcaaggtggtgggcggggataccgtcattggctttgggacggattcggtgacgctggtgggtgtgagcagtctgtcgggggaggggatagtcatcagctaa

SEQ ID NO: 736 - protein, 474 aa, Unknown
  Obtained from environmental sample
  DOMAIN (133)...(265): Lipase (class 3)
MGIFDYKNLGTEDSKALFADAMAITLYSYHNLDNGFAVGYQNNGLGLGLPATLVSALIGGSNAQGVIPGIPWNPDSEKAALEAVQAAGWTPISASTLGYSGKVDARGTFFGEKFGYGTAQAEVLGKYDDAGKLLEIGISFRGTSGPRESVITDSIGDVISDLLAAFGPKDYAKNYAGEAFGGLLKNVADFASAQGLGGNDVVVSGHSLGGLAVNSMADLSDSTWSGFYKDANYVAYASPTQSAGDKVLNVGYENDPVFRALDGSSFNLSSLGVHDKAHESSTDNIVSFNDHYASSLWNVLPFSILNLPTWVSHLPTGYGDGMTRILDSGFYEQMTRDSTVIVANLSDPARATTWVQDLNRNAEAHKGNTFIIGSDGDDLIKGGRGADFIEGGKGNDTIRDSSGHNTFLFSGQFGNDRVIGYQATDKLVFNDVAGSNDYRDHIKVVGGDTVIGFGTDSVTLVGVSSLSGEGIVIS

SEQ ID NO: 737 - DNA, 852 bp, Unknown
  Obtained from environmental sample
atgagcgaccagcggaccgccctcgtgctcggcggcggcggcatcacgggcatcgcctgggagatcggcgtgctggccggcctggccgagctcggtgtcgacctcaccggcgccgacctcgtcgtgggcacgtcggcgggctcggtggtgggcgcccaggtgaccagcggcgctccgctggaggagatgtacgcccgccagctcgagccgccggcgcgggagaaggtggcccgcatgacgcggggcaacctggcccgctacgcgtgggcgatgctcaccagccgcgggcgcgacgtcgagttccggcgccggatcggagcgctggccctggccgccgagaaggccgggctgaccccgtcggagcaggagcggctcgacgtcatcggctcccggctggtgtcgaaggaatggccctcccgcgacctgacgatcaccgcggtcgacgccgccacgggggagttccgcaccttcgaccgcgggtccggggtgccactgctgcaggcggtggccgccagctgcgcggtgccgggcgtctacccgccggtcaccatcgacgggcgccgctacgtcgacggcggaatgcggtcggcggccaacgccgacctggcgaacgggtacgaccggctggtcgtcctggcgcccatcccgcgcggggtcggcccgctggccagcgtcgacgcgcaggtgtcgggcatggtgtcgcgcgtggccgtcgtggccccggaccaggccagccggacggccatcggccgcaacgtcctggaccccgccgcccgcgagcccgcggcgcgggccggccgggtccaggcggcgcaggcgctcacccgggtggcggaggtctgggccggctga

SEQ ID NO: 738 - protein, 283 aa, Unknown
  Obtained from environmental sample
  DOMAIN (8)...(204): Patatin-like phospholipase
MSDQRTALVLGGGGITGIAWEIGVLAGLAELGVDLTGADLVVGTSAGSVVGAQVTSGAPLEEMYARQLEPPAREKVARMTRGNLARYAWAMLTSRGRDVEFRRRIGALALAAEKAGLTPSEQERLDVIGSRLVSKEWPSRDLTITAVDAATGEFRTFDRGSGVPLLQAVAASCAVPGVYPPVTIDGRRYVDGGMRSAANADLANGYDRLVVLAPIPRGVGPLASVDAQVSGMVSRVAVVAPDQASRTAIGRNVLDPAAREPAARAGRVQAAQALTRVAEVWAG

SEQ ID NO: 739 - DNA, 759 bp, Unknown
  Obtained from environmental sample
gtgcgtttcgtcgattgcaagactgcgaattgctcgctgccggttcttgaagtcaacggcgaggtgggcgttctgttcgttcacggtttcacaggttcgccgcacgacttcacttacatggcgaagaggacctgcgaagctggcttcacggtctcaattccacgcttgcctggtcatggtacgtgcggtcaggacttcttgaccaccacggcacacgattggctccgtcgggcgttcgatgcctactacgatctgaaagcgatttgcaaggatgtgcacatagtcggtctgtccatgggtggagtcatagcgatcatcatggcgtctgttttgaagccaaaaaaactcgtgaccttggctgctgccacgcacctgagcagtaacagaataaaactcgctaagttcgtcgctctcttcagggacaaactcccaaagcaaaaatcgcagacgtatgaagatcctgccatggagactctcaacaaagagtattggtcctacgaatggcccaagcagggtgcagaactctacaagttgatcaagttgtcgaggaaggctgtgcggcaaatagtttctgaaacgctcgtggtcgcggcgcgcaacgatgaactggtgcctctgaaagctgcgcagttcatctacgataacgttcgctctgagaagagaaaactcttgatcttcgaaaagtcgggccacgtactttccaacgacgtggagaaagaagcggtcacagacgcagtcttggattggctgagatcttga

SEQ ID NO: 740 - protein, 252 aa, Unknown
  Obtained from environmental sample
MRFVDCKTANCSLPVLEVNGEVGVLFVHGFTGSPHDFTYMAKRTCEAGFTVSIPRLPGHGTCGQDFLTTTAHDWLRRAFDAYYDLKAICKDVHIVGLSMGGVIAIIMASVLKPKKLVTLAAATHLSSNRIKLAKFVALFRDKLPKQKSQTYEDPAMETLNKEYWSYEWPKQGAELYKLIKLSRKAVRQIVSETLVVAARNDELVPLKAAQFIYDNVRSEKRKLLIFEKSGHVLSNDVEKEAVTDAVLDWLRS

SEQ ID NO: 741 - DNA, 1014 bp, Unknown
  Obtained from environmental sample
atgaggcgaagaaccgcagggtttgacatccggatggacggccactatagtcgctttcaacatatagggacaggagatccggacatgcagcacacaagcaggcgaagcttcgttcagtcggccgcaatcgcgggcgtcgcggcggctttcggaccggagggagtcgaggctcggcagaccgctccggccggaataagggtggaaaatgacatcgttttcggaaagggcggcgacatggatctccgcctggacatctaccacccaaccgcgggaacttcaaagcggatggcggccattcacattcatggcgggggttttcaagccggcagcaaagccggtgtcgcgagctcgtcccgcgcgtttgccgaactcggttacgtcagtatcgcctcgcaataccgtttgaccgggcaaggccggtggccggcccagatcgaagatgtcaaagcggccatccgctggacccgcgccaacgcgacgcggctgaacatcgatgccgacaagattgcggtggccggttactcggcgggcggcctgatggcgctctttgccgcggccacgccggaccgcaaggagttcgagggcagtgggggcaatccaggcgtgagcacgaaggtttcggcctgcgtcgcgttttaccccgctacaacggccaacgcgaacctcctgccggaaggcagcgaccggacggcgatagatgccgcgtctcccatcaactacatctcggcgagcttcgctccgacgatctttctccacggggtcgaggacacgaccatccggcccgaaaacagtatggcgttcttcgagaagctccgggccgccggcgtcaaggtggacctgcacttgttccagggcgcgcctcacgctttcgaggtcaataatcccgacgccgcgctggcgtccgctcaggtcaccgacctgttcttcgatcggcttgttctcaacccaagggaatatccgccattcggcggaggacggggcggccgaggcggcgcacgcggcgggccacagtag

SEQ ID NO: 742 - protein, 337 aa, Unknown
  Obtained from environmental sample
  DOMAIN (103)...(312): Dienelactone hydrolase family
MRRRTAGFDIRMDGHYSRFQHIGTGDPDMQHTSRRSFVQSAAIAGVAAAFGPEGVEARQTAPAGIRVENDIVFGKGGDMDLRLDIYHPTAGTSKRMAAIHIHGGGFQAGSKAGVASSSRAFAELGYVSIASQYRLTGQGRWPAQIEDVKAAIRWTRANATRLNIDADKIAVAGYSAGGLMALFAAATPDRKEFEGSGGNPGVSTKVSACVAFYPATTANANLLPEGSDRTAIDAASPINYISASFAPTIFLHGVEDTTIRPENSMAFFEKLRAAGVKVDLHLFQGAPHAFEVNNPDAALASAQVTDLFFDRLVLNPREYPPFGGGRGGRGGARGGPQ

SEQ ID NO: 743 - DNA, 900 bp, Unknown
  Obtained from environmental sample
atgcccggagcccgtcgtctacgtgccgtcgtcgccgccgtcgcggtgaccgttcccctgaccctcaccgtcccggccgcgcaggccgcacccccgccgccggccgcccagccgtcgaccgcgctcaccgatgacctgctggtgatcggccaccggggagcgtcgggctaccggcccgagcacacgctggcggcctacgagctggcggcacggatgggtgccgactacatcgagcccgacgtggtgagcacgaaggacggcgtcctcgtggcccgccacgagaacgagatctccgggacgaccgacgtggcggcccggccggagttcgccgaacgccgcacgacgaagaccatcgacggcgtcgcgttcaccggatggttcaccgaggacttcaccttggccgagctgcgcaccctgcgggcggtggagcggctgcccatggtccgcgaggagaacaccctgtacgacgggctgtaccaggtgcccaccctcgacgaggtgctggagctgcgggcgcagctgtcccgggagctgcggcgcgacttgggcgtctacatcgagaccaagcacccgacgtacttcgacggaccgggctgtcgctggaggagccactgctggccgacctccgcgaggcgcacctggaccggaccggctccccggtcttcatccagtcgttcgagacggggaacctgcgtgaactggaccggaccggcgtgcgggccccgctcgtgcagttgctgtccgcgtccggcgccccgtacgacctcgtggtcgcgggcgacgcgcgcacgtacgccgacctgtccagcgctgcggggctgcaggagatcgccacctacgcggagggggtcgggccggacaagaaccaggtcatcccggtcgggcccgacggggcgctga

SEQ ID NO: 744 - protein, 299 aa, Unknown
  Obtained from environmental sample
  SIGNAL (1)...(29)
  DOMAIN (51)...(286): Glycerophosphoryl diester phosphodiesterase family
MPGARRLRAVVAAVAVTVPLTLTVPAAQAAPPPPAAQPSTALTDDLLVIGHRGASGYRPEHTLAAYELAARMGADYIEPDVVSTKDGVLVARHENEISGTTDVAARPEFAERRTTKTIDGVAFTGWFTEDFTLAELRTLRAVERLPMVREENTLYDGLYQVPTLDEVLELRAQLSRELRRDLGVYIETKHPTYFDGPGCRWRSHCWPTSARRTWTGPAPRSSSSRSRRGTCVNWTGPACGPRSCSCCPRPAPRTTSWSRATRARTPTCPALRGCRRSPPTRRGSGRTRTRSSRSGPTGR

SEQ ID NO: 745 - DNA, 747 bp, Unknown
  Obtained from environmental sample
atgaaaattagacaaccacaaccatttacatttgaagcaggaaaaagggccgttttattattgcatggatttacaggtcattcggcagatgtacgcatgcttggtcgctatttagaggaaaaaggttatacctctcatgcgccaatttatcgtggccatggtcttccacctgagcagctcatggaaacaaatccaaacatgtggtgggaggatgttgtacaagcatatgaacatttacgtcaactcggttatgaagaaatagcagtggccggcctatcgttaggtggaatgatggcattaaagttagcgacagagacaaaaataaaagctgttatatcgatgtgtgttcctatgatatttgatgataaaaataatttaacagagtcttttgagcgttttgtacgacaatataaacagtttgaaaaaaaggataaagcgacgattgatcatgaaacagaacaaataatggaacaatccgttgatttgtttgaggaaattaaagcatttaatttatcggttaaagaagtcattgatttgatttatgcaccaacacttgttatacaagcacgtaacgatgaggttattaatcctgaaagtgcacaatatatatatgattcagttgaaacagatgaaaaagaaataaagtggtatgaagaatcaggccatgttatcacattaggtgaagaacgcgaccaattacatgaagatatttatatgtttctcgaacagttagaatgggaacaataa

SEQ ID NO: 746 - protein, 248 aa, Unknown
  Obtained from environmental sample
MKIRQPQPFTFEAGKRAVLLLHGFTGHSADVRMLGRYLEEKGYTSHAPIYRGHGLPPEQLMETNPNMWWEDVVQAYEHLRQLGYEEIAVAGLSLGGMMALKLATETKIKAVISMCVPMIFDDKNNLTESFERFVRQYKQFEKKDKATIDHETEQIMEQSVDLFEEIKAFNLSVKEVIDLIYAPTLVIQARNDEVINPESAQYIYDSVETDEKEIKWYEESGHVITLGEERDQLHEDIYMFLEQLEWEQ

SEQ ID NO: 747 - DNA, 942 bp, Unknown
  Obtained from environmental sample
atgaagctcgacgacgaagccgccatggtgctggacctgatgaagaaatcgggccggccggcgctggagacgctcgacgcggcggcggcgcgcgcccaggccgacgggctgtcggagaaaagcgagatcgatccgccggaggtggcgaaggtcgtcgacggcacgctgcccggacccggcggcccgatccggttccgccgctactggccgatcggggccggcggcgcgaccctgccgacgctgatctactaccacggcggcggcttcgtgatcggcaatctggagacccacgactcgacctgcaggcggatcgccaatgtcagccagtgccaggtcgtcgccatcgactatcgcctcgcgcccgagcatcccttccccgcgccggtcgacgacgccatcgccgctttccgccacatcgccgccaatgccgcgcagttcgacacggaagccgatgcgctcgcggtcggcggcgattcggccggcggcaatctcgctgcggtgatctgccaggcgcagagggaaacgggcggccagatgccctcgttccagctgctgatctacccggccaccgacaaccgcaacgaaagcccgtcgcgacgcatgctgggcgacggctatttcctcaccacggcgctgatgaaatggttcttcgaccactacgcccccgcaggcgtcgatcgcaccgatccgcgcatctcgccgctgttcgccaaggactattccggcctgccgccggccttcgtgctgaccgccggtttcgatccgctgcgcgacgagggccgcgactacgccaaccggctgatcgacgcgggcgtcaaggtcacctattccaactatcccggcaccatccacggtttcttctcgatgacgcgtttcctcaagcagggcttgcgcgccaacgacgaggccgcctgcgcgctgaaggtgcatttcggcatctga

SEQ ID NO: 748 - protein, 313 aa, Unknown
  Obtained from environmental sample
MKLDDEAAMVLDLMKKSGRPALETLDAAAARAQADGLSEKSEIDPPEVAKVVDGTLPGPGGPIRFRRYWPIGAGGATLPTLIYYHGGGFVIGNLETHDSTCRRIANVSQCQVVAIDYRLAPEHPFPAPVDDAIAAFRHIAANAAQFDTEADALAVGGDSAGGNLAAVICQAQRETGGQMPSFQLLIYPATDNRNESPSRRMLGDGYFLTTALMKWFFDHYAPAGVDRTDPRISPLFAKDYSGLPPAFVLTAGFDPLRDEGRDYANRLIDAGVKVTYSNYPGTIHGFFSMTRFLKQGLRANDEAACALKVHFGI

SEQ ID NO: 749 - DNA, 804 bp, Unknown
  Obtained from environmental sample
gtggccaaagcgacacggcgcgccacgtcaatccccgcccgggccgccggagccgcgcttctcctcctcgcgttgaacgcgtctgtcctagctgccggctgcgccgacccgacttcgctcggcgtttcgagggtgctcacggtcgacacggccggcggcctcgaggttggcgccttcaatttcgccaagacgctgccgcttggcgacatggaggtcgtactcaccttcgacgacgggccgctgcccggcgtcaccgagcgcgtgctggcggcccttcgcgccgaatgcgccaaggctacctttttcgtcgtcggccggatggcggccgaggcgccacgtctggtgcaggccgagctcgccgacggccacacgatcggcaaccacacacagaaccacccgatgccgatcggacgcctgtctttcgaggccggcgcccgcgacatcgacgccggctttgccacgctcaagatggtgctcggccagccgcctgcgcccttcttccgctaccccggttttgccatgacggcgccgcttgaggcccgactcgctgccgccaatatcgggacgttcagcaccgacgtgatgggctatgactggcagacgatcacgcccgatcaggtccgccagaacgtccttgctgggctggctcgccgccgcggcggcatcatccttctccacgacatccaccgtcgcaccgccgacatgctgccgcagcttctccgggatctcaaagagcgcggcttcaggctcgtccacatccagccggcgcacccctgtccggccgacggctgccggatcgagtag

SEQ ID NO: 750 - protein, 267 aa, Unknown
  Obtained from environmental sample
  SIGNAL (1)...(31)
  DOMAIN (65)...(190): Polysaccharide deacetylase
MAKATRRATSIPARAAGAALLLLALNASVLAAGCADPTSLGVSRVLTVDTAGGLEVGAFNFAKTLPLGDMEVVLTFDDGPLPGVTERVLAALRAECAKATFFVVGRMAAEAPRLVQAELADGHTIGNHTQNHPMPIGRLSFEAGARDIDAGFATLKMVLGQPPAPFFRYPGFAMTAPLEARLAAANIGTFSTDVMGYDWQTITPDQVRQNVLAGLARRRGGIILLHDIHRRTADMLPQLLRDLKERGFRLVHIQPAHPCPADGCRIE

SEQ ID NO: 751 - DNA, 1407 bp, Unknown
  Obtained from environmental sample
atgcctcaagcctcttcccaggccagcaacgccttcaccgaaatcgacaccttccgccacctgtacgaccgcggcgacggtcaggtcaacggcaaaccgtcgttcaccgccgaccaggccgccgccgagatcctgcgcaagggcatgtcctggcaggacaagaacggcgacggcaagatcgacctcagctataccttcctgaccgacaagcctgccaactacaacccgaaactgggcaacttcggcgagttcagcgccctgcagaaagcccaggccgtgctcgccatgcaatcctgggccgacgtggccaacgtcaccttcaccgaaggcaacggcggcgacggccacatgacgttcggcaactacgacgtcagcaccggcggcgcggcgttcgcctacctgccccagggcagcagctacgacggccagtcgtggtacctgatcaacgaccagtaccaggtcaacaagactcccggcaccaacaactacgggcgccagaccctgacccacgaaatcggccacaccctcggcctgtcgcaccccggcgcctacaacgccggcaacggcaacccgacctacggtgacgccaagtacgccgaagacacccgcggctacagcctcatgagctactggagcgaaagcaacaccgcccagaacttcagcaaggacggcagcggcgcctacgcgtcggcgccgttgctggacgacatcgtggcggtgcagaaactctacggcgccaacctgcagacccgtgccgacgacaccgtctacggcttcaactccaacgccgagcgcgacttctacagcgccacctccaacagctccaaggtggtgttctcggtgtgggacggcggcggcaacgacaccctggacttctccggcttcagccacaaccagaagatcaacctcaatgaaggttcgttctccgacgtcggcggcctggtgggcaacgtgtccatcgcctatggcgtgaccctggagaacgccatcggcggttcgggcaacgacctgctgatcggcaacgcggcggccaacgaactggtgggcggagccggcaacgacctgatctacggcggtggcggcggcgacacgctgtggggcggggaaggggccgacaccttcgtgttcggcgcggccagcgactcgaccatgaccgcgccggactggatcatggatttcaccagcggcctggacaagatcgacctgtcgggcatcgccggcttcgccagcggcgcggccacgctgaacttcgtcagcggcttcaccggccatgcgggcgatgcgatcctcacctacttcgcgcagaccaaccagaccagcctgatgatcgacctgaccggccaaggttcggtggacttcgccgtgggcgtggtggggcaggcgctggcaagcgacatcgtcgcgtga

SEQ ID NO: 752 - protein, 468 aa, Unknown
  Obtained from environmental sample
MPQASSQASNAFTEIDTFRHLYDRGDGQVNGKPSFTADQAAAEILRKGMSWQDKNGDGKIDLSYTFLTDKPANYNPKLGNFGEFSALQKAQAVLAMQSWADVANVTFTEGNGGDGHMTFGNYDVSTGGAAFAYLPQGSSYDGQSWYLINDQYQVNKTPGTNNYGRQTLTHEIGHTLGLSHPGAYNAGNGNPTYGDAKYAEDTRGYSLMSYWSESNTAQNFSKDGSGAYASAPLLDDIVAVQKLYGANLQTRADDTVYGFNSNAERDFYSATSNSSKVVFSVWDGGGNDTLDFSGFSHNQKINLNEGSFSDVGGLVGNVSIAYGVTLENAIGGSGNDLLIGNAAANELVGGAGNDLIYGGGGGDTLWGGEGADTFVFGAASDSTMTAPDWIMDFTSGLDKIDLSGIAGFASGAATLNFVSGFTGHAGDAILTYFAQTNQTSLMIDLTGQGSVDFAVGVVGQALASDIVA

SEQ ID NO: 753 - DNA, 1623 bp, Unknown
  Obtained from environmental sample
atgcataagttcatatccatgggcgcgttttcagtagtagccattgcttgtagcagtttactcatgggatgccaaaacgaaatatccaatcagaagtccgcacaagttgatccgacaatggtaaaaacctccagtggccaggttaaaggttcgattgacggggaaatattatcgtttaaaggtataccatatgcgtttccgccggtgggggatctgcgctgggaggcgcctcaggcaatcacttggcaaggtgttcgctcagcgactgaatacggtaacgactgcatgcaagagccttttcccagtgacgcagcgcctcttggaactgagcctgcggaagattgcctggtcctgaatgtttggaaaaaggccaataataatgataaaccattgccggtggtggtgtggatctacggtggcggttttgttaacggaggttcttctcctgcggtatatgacggcagtgcgtttgccagtaaagatgtgatttttgtcagtttcaactaccgcctggggcgattcggtttcttcgcccatccagcgctgaccgctaaaaaagatggcctgttaggtaactacggttacatggatcaaatcgcagccatgaagtggattaatgacaatattgcagcttttggtggtgatcccaatgccattaccattatgggggaatcggcgggtggcttctcggtgattaacttgatgctcgcggagcaagctcgcggtctgttccagcgcgccattattatgtcgggtggcggccgaacccgagctaacgcagaccgcggtattgatactgcgccagaaggacaattgactgctgagcaagttggtattaattttgccaaggctaacggtattgaaggcacaggtcctgacgcattggctgcacttcgtgctttaagcgcagagcaagtgaccgatggtctcaatatggcttacttgtttatgcctaaggaaggtccagaaacctatgttggtggccctatcaaagacggcgaaatgatcaccgaagatataggtgttcgcatcgctaaaggcgatgctgtcaaggtccctgtattgatcggcactaccagtgcggatatcggtttcgccagtggcaataccaaagatgagttgtttgccagcttcggcgattatgccaacgaagcgcgccaggcatacgatcccaacggcgacctgtcactacaggagttgaagatgctggttggtagtgaccgctttatgaatgagccagcgcatttcgtatctcgcgagttaagccgtctgggccagccagtgtggctgtaccgtttttcctacgttgctgagagcatgcgtgacgaatggagtggggctcctcacgcaacagatatcccattttttctcgatactgtgaacgcgaaatacggtgaccagttgaccgcccaagaccgccatgcagcattcctggcgaatgaagctttcgttaattttgttaagaccggcaacccaaatccagcgggtgtagaagactggccgacttaccaaggccctcacggtccaatcatgaatttctctcacaaggccactgcggaggttattcacgatccttggcaggaacgcctttcggtagtgacccgcgctgctgatgaacaataa

SEQ ID NO: 754 - protein, 540 aa, Unknown
  Obtained from environmental sample
  SIGNAL (1)...(23)
  DOMAIN (13)...(529): Carboxylesterase
MHKFISMGAFSVVAIACSSLLMGCQNEISNQKSAQVDPTMVKTSSGQVKGSIDGEILSFKGIPYAFPPVGDLRWEAPQAITWQGVRSATEYGNDCMQEPFPSDAAPLGTEPAEDCLVLNVWKKANNNDKPLPVVVWIYGGGFVNGGSSPAVYDGSAFASKDVIFVSFNYRLGRFGFFAHPALTAKKDGLLGNYGYMDQIAAMKWINDNIAAFGGDPNAITIMGESAGGFSVINLMLAEQARGLFQRAIIMSGGGRTRANADRGIDTAPEGQLTAEQVGINFAKANGIEGTGPDALAALRALSAEQVTDGLNMAYLFMPKEGPETYVGGPIKDGEMITEDIGVRIAKGDAVKVPVLIGTTSADIGFASGNTKDELFASFGDYANEARQAYDPNGDLSLQELKMLVGSDRFMNEPAHFVSRELSRLGQPVWLYRFSYVAESMRDEWSGAPHATDIPFFLDTVNAKYGDQLTAQDRHAAFLANEAFVNFVKTGNPNPAGVEDWPTYQGPHGPIMNFSHKATAEVIHDPWQERLSVVTRAADEQ

SEQ ID NO: 755 - DNA, 1365 bp, Unknown
  Obtained from environmental sample
atgaaattgcaactcttaatacttttagtttttgtgatttctgttgttggagctactaaaatcagcgatcttggagaagtctatactgtgaaaactgcggacggagttacattgaaactcctgagatatcatccacccggagggcaaccaaacgttggagctcagccagttttgctattttctggattgctttgcaacatgaatgaatttgttgtattcacaccagatggacttgaaagcaagtacaaaccctactatcctaaggaacttgcagaatgggctaaagatgatctctacatagccaaagacccgatgctctactacagtctagcacactacttgtggaagaaaggttacgacgtatggctgctcaactatcgtggaactggtgtaggagagatgaaaagcggtgttggaaatgcaagagttagccttgacgtctgggccctttacgatgtccctgcagcgatcgattttgtaaataaaaagactggaaaaagtctaattattggcggccacagcacgggagggcttgtaacctatgtttatctccaaggagcaaaatttgtcaaaactccatcatgcctgataaatttggcttggtgtgaaaaagtttcggcatcagattcgcttgcaaaagaaagaaacagtaagatcgttggcgtcattgcaatcgacccagcaatgattcctcctttgcccaaaatacttgatacaaaagccggatggttgcttcttgacacaccgctttacatagacttgagggacacaattgagactttagcgaagaaaaaagggctgtgggaaagtttccttttgactgagaagtttttattcgaagctatatactcgctttactatcgctacggagagatatctgagataataaaagctctggctttcatgaatccgaacaacatgaatcctgctttgtcagacttcatgacaagatacgtagccgatagtctttacacacctacattagcccagtacgcagattttggtttaagaaatactgcaagagagtattttgaaaacggtgggaagggatatctggtcgttccaccatggcccaggcctggcgatggttactactattataaaggagagaatatgaaaaaagttaaagttccatatataactatcctctctgagcttccaggtttggttgatgcaaatcaaattataaaagacttgatgcaggctaaaacaaagcatcaactcgacagataccatataatctctggcacgggacacttagacgtagccttgggtctgaatgtcccgacagaagtctttccgaaaattggagcttggcttgatggtctgcaagaattaataggatacccaactactccgcattaa

SEQ ID NO: 756 - protein, 454 aa, Unknown
  Obtained from environmental sample
  SIGNAL (1)...(17)
MKLQLLILLVFVISVVGATKISDLGEVYTVKTADGVTLKLLRYHPPGGQPNVGAQPVLLFSGLLCNMNEFVVFTPDGLESKYKPYYPKELAEWAKDDLYIAKDPMLYYSLAHYLWKKGYDVWLLNYRGTGVGEMKSGVGNARVSLDVWALYDVPAAIDFVNKKTGKSLIIGGHSTGGLVTYVYLQGAKFVKTPSCLINLAWCEKVSASDSLAKERNSKIVGVIAIDPAMIPPLPKILDTKAGWLLLDTPLYIDLRDTIETLAKKKGLWESFLLTEKFLFEAIYSLYYRYGEISEIIKALAFMNPNNMNPALSDFMTRYVADSLYTPTLAQYADFGLRNTAREYFENGGKGYLVVPPWPRPGDGYYYYKGENMKKVKVPYITILSELPGLVDANQIIKDLMQAKTKHQLDRYHIISGTGHLDVALGLNVPTEVFPKIGAWLDGLQELIGYPTTPH

SEQ ID NO: 757 - DNA, 1257 bp, Unknown
  Obtained from environmental sample
atgcagggattcccgtttttcccggtggaattcgaccggcacgggcagccggtgaaccgggcgcaggcggcggaactggtggcgtggctggcggcggacggggcgggcgcgcaggccgtggcgttcgtgtcgcacgggtggaacaacaacatggaggaagcgcggtcgctttacgacaggctgctggggaatgtgcggcgccagggtgctccggcggggctggcggtggtggggttgttctggccctcgaagaagtttacggacgaatcgctgatcccgggaggggcggcgagcgtggaggaggcgggcgcggagtccgtgctggagcagacgctggatgcatggctggcggacgagaccgatccgaggtggcggcaagcgatggaagactgcaggcgcgaggttccgaagctggagagcgatccggcggtgcaggaccgttgggtggagcggctggcggggttgctggaccggcagggcgatgacgatttcgaggccgtcgcagacctgcgggcgaagccggggcgcgaggtcctggaggcgtttgcgccgccggtggtgtttgacctgccgccagaggaggagagcggggcggcgggagtgcgtgcgatggggctgggcagctttttggggggcatcacgggcggggcggcgaaattcctgaacctgtttacctattacgcgatgaaggaccgggcggggctggtgggcatggacggattgaatccgctgatgcggcaggtggcgagcgtgcgggccgggttgcggctgcacctggcggggcatagttttggggggcggctggtatcggctgcgctgcggcagggcggagtgaaggcgagttcgctgacgctgctgcaagccgcgttttcgcattacgggttcagcgacagagtgccggaaattggcggcaaagcgggctttttccggcccgcgttgaatcaggtggcggggccggtgctggtgacgcacacggcgaacgatctggccgtgggggtggcgtacgcggtggcgtcgcgggtggcgaaccaggtggcggcgggggtgggcgacgcgggggatccctatgggggcatcgggcggaacggagcgctgcgaacgccggaagcggtgagcgggcggctgctgcaggcggggcaggcgtacaccttcgagaaggggaaggtgcataacctggaggcgagtgcatttgtgcgggatcacggcgacgtaacgggcgcggaagtggcgtgggcgtgggtgaacgcgatgcgctga

SEQ ID NO: 758 - protein, 418 aa, Unknown
  Obtained from environmental sample
MQGFPFFPVEFDRHGQPVNRAQAAELVAWLAADGAGAQAVAFVSHGWNNNMEEARSLYDRLLGNVRRQGAPAGLAVVGLFWPSKKFTDESLIPGGAASVEEAGAESVLEQTLDAWLADETDPRWRQAMEDCRREVPKLESDPAVQDRWVERLAGLLDRQGDDDFEAVADLRAKPGREVLEAFAPPVVFDLPPEEESGAAGVRAMGLGSFLGGITGGAAKFLNLFTYYAMKDRAGLVGMDGLNPLMRQVASVRAGLRLHLAGHSFGGRLVSAALRQGGVKASSLTLLQAAFSHYGFSDRVPEIGGKAGFFRPALNQVAGPVLVTHTANDLAVGVAYAVASRVANQVAAGVGDAGDPYGGIGRNGALRTPEAVSGRLLQAGQAYTFEKGKVHNLEASAFVRDHGDVTGAEVAWAWVNAMR

SEQ ID NO: 759 - DNA, 885 bp, Unknown
  Obtained from environmental sample
atgaaaacaaccatacacccaaagctggagcgaacggatatcgtcctgatggatgacgtcgtctattctcagccgctggcgtattttggtagaagaccacacccgcttaagatgatgctcctccgcccgattgagtggtggggcgagacgcagctcctgccgcttccgacgatcctctgggtcgtgggcggcgcgtggcagcagacgtttccctcctggcgcatggcagagtttagttatttggcctatgcggggtatcaggtaacggcaatcgactaccgaacgatcaatgaagcggcgtttcccgcgcaagtggaggactgcaaagctgcggttcgcttcctccgcgcaaacgcaaaacgctatggcgtagatccggagcgcatcggcatcatgggcgactcggcgggcggctatctcgctgctatgatcggtgcaacgggagatgatcccgcgtttgaaaccgacgaatgggcgggatattccagcgcggtgcaggctgttgcggactggtatggccctatcgatatgctgcgtatggggcagtatgccaaggagcaaaacccggatgcgggagaagaggacacgctgctcttccgcctctttgcgggctgcccgatcacggaggagaaccataagtttcttgagagcatgagtccggagcgctatgtttcggcaaatacgccgccgcatctgattttgcacggcacggcggacgagatggttgatgtacgcgagagcgagcgttattacgaggcgctgacgaaggcgggcgtgcctgccgatttggttctgctcgaaggggcagggcattgcgaccaagcattttcacagccggaagtgcagaatatcatacttgagtttttcaccaaacatttaaagtaa

SEQ ID NO: 760 - protein, 294 aa, Unknown
  Obtained from environmental sample
MKTTIHPKLERTDIVLMDDVVYSQPLAYFGRRPHPLKMMLLRPIEWWGETQLLPLPTILWVVGGAWQQTFPSWRMAEFSYLAYAGYQVTAIDYRTINEAAFPAQVEDCKAAVRFLRANAKRYGVDPERIGIMGDSAGGYLAAMIGATGDDPAFETDEWAGYSSAVQAVADWYGPIDMLRMGQYAKEQNPDAGEEDTLLFRLFAGCPITEENHKFLESMSPERYVSANTPPHLILHGTADEMVDVRESERYYEALTKAGVPADLVLLEGAGHCDQAFSQPEVQNIILEFFTKHLK

SEQ ID NO: 761 - DNA, 606 bp, Unknown
  Obtained from environmental sample
atgaaggttaaacacgttattgttttacatggcttatatatgtctggcttggtgatgcgcccgttatgttcgcgtctagaagagtcgggggttaaagttttaaacttaacctacaatactcgagaccctaatcgagatgctatttttacgcaaatagatgagtttattagcaatgagccttctgctttagtgtgtcactctatggggggcttagttgctcgcgcctatttagaggcaaactcagcgccaagtcatcatgttgaaaaggtaatcaccttaggaacgccacatactggcagccatattgctgaaaaaatgcagcaaaaagggttcgagctattattaaaaaatagcgttgagtttttactctctaagaatggtgattggccttttaaagccaagctatatagcattgccggcgacttaccgattggcttaatgccactcattgtaaaaggcagccgctctgatggcactgtattgctagatgaaaccaagctaaagggtatggctgaacacaaggtgtttcatttaagccatacaagtatgatttactctcgccaagtcgttaattatattcttgagcgcttgaacgaggacatttaa

SEQ ID NO: 762 - protein, 201 aa, Unknown
  Obtained from environmental sample
MKVKHVIVLHGLYMSGLVMRPLCSRLEESGVKVLNLTYNTRDPNRDAIFTQIDEFISNEPSALVCHSMGGLVARAYLEANSAPSHHVEKVITLGTPHTGSHIAEKMQQKGFELLLKNSVEFLLSKNGDWPFKAKLYSIAGDLPIGLMPLIVKGSRSDGTVLLDETKLKGMAEHKVFHLSHTSMIYSRQVVNYILERLNEDI

SEQ ID NO: 763 - DNA, 1599 bp, Unknown
  Obtained from environmental sample
atggcactagccgaaccccattccgcgtggccgatcatctacgttcgcggctacgccatgacgcgtacggaaatcgacgaaacgacggcggatccgttctgcggattcaacatcggatccaccgttttgcgagccacgccggacaaaacgacggcgccgcgaaaactgatcttcgagtcgccgctggtgcgattgcagtccgacttcggctattgcgacgtttacgaggatggcgtcgacatcggcgatcccgatttcacggaagagatcgacaagaaatccgtcatcatctatcgctactacgacgatgcgtcgacgttgttcggcaccggcaaaacgcccgagatcgaggcatttgcgaaaggcctcggcgatctgatcctgcgcgtcagggagttggtctgccgtaacccggacaacaaagtcgcgacgaaggattttcgctgtcacctcgtggcgcactcgatgggcggcctggtgtgtcgggcgttcctccagaactcaaaactgggcgatgcgacagcgcgcaaatgtgtcgataagttcttcacctacgcgacgccgcacaacggcatcgaaatggcggggatcaacgtgcccgagttcctcgggctcaacgacatcaacaacttcaaccgcaatcgcatggccgagtacctggatctcgatgccacgttcaagaagaccaaacgcgtggactggattccggaagagtcgtttccgtcatcgcgcatcttctgcatggttggcacgaacaacggcgactacaacgtagcggcagggctgtcgcgcacgtttgccggcaacggcagcgacggcctcgtgcaagttgctaacgcttccgtttgggggatcaacgcgcagggtaagacctccgatccgtgcgcgacagcgtactgctttcgatcgcactcaggccggtatggcatcgtgaacagcgaagaggcgtaccagaacctcgtgcgttttctgttcggcgacgtccgcatcgatatgtgggccgacattcaaagcgcgcgggttccgcagcagctcgaggacaaggatgcagaggggaaggtcgatgcgctgtaccagttcgaggtgctcgcgtctccacgcggcaagcgttggtatctgacgcggcgaatcgccgaggaagactccgttgcgtgtcgggaccattcggtgctgaagaaggcgacggtcgcgaagccggaatcgatttacctttcgaccgtcttcctggccaatcgatatcgggtcaacaagaaactacgaacgctgtcgtactcgatgatgctcgcggtgcgcgcacctgactacgaagtggagaagcggttctggcccgaccggcactatgaaggcggatacctgtatcgcgacaccgtcgtgatcgagctgaagccgccggcgcgcgcgggaggcgagtggcaggtgctctacaactggcagagcaaagacgtcgcccaggcgacgattccgctcaccgtggaaaaactgagcgcgggcgcggtcgagatcgatattccattcgcgaccgccgatgagacgccgccgcgatcgccgggcgtgtcgggcaagttgcggttcgtcatttcgttgtggaatcgggagtga

SEQ ID NO: 764 - protein, 532 aa, Unknown
  Obtained from environmental sample
MALAEPHSAWPIIYVRGYAMTRTEIDETTADPFCGFNIGSTVLRATPDKTTAPRKLIFESPLVRLQSDFGYCDVYEDGVDIGDPDFTEEIDKKSVIIYRYYDDASTLFGTGKTPEIEAFAKGLGDLILRVRELVCRNPDNKVATKDFRCHLVAHSMGGLVCRAFLQNSKLGDATARKCVDKFFTYATPHNGIEMAGINVPEFLGLNDINNFNRNRMAEYLDLDATFKKTKRVDWIPEESFPSSRIFCMVGTNNGDYNVAAGLSRTFAGNGSDGLVQVANASVWGINAQGKTSDPCATAYCFRSHSGRYGIVNSEEAYQNLVRFLFGDVRIDMWADIQSARVPQQLEDKDAEGKVDALYQFEVLASPRGKRWYLTRRIAEEDSVACRDHSVLKKATVAKPESIYLSTVFLANRYRVNKKLRTLSYSMMLAVRAPDYEVEKRFWPDRHYEGGYLYRDTVVIELKPPARAGGEWQVLYNWQSKDVAQATIPLTVEKLSAGAVEIDIPFATADETPPRSPGVSGKLRFVISLWNRE

SEQ ID NO: 765 - DNA, 1260 bp, Unknown
  Obtained from environmental sample
atgcaccttgaaaccacccgatttttatccgccgggcagacccgcggtctcgcctccacctatggcaccccattgtatgtgtatgacgaaacgacgctccgtcagcgcgcggaagaaaccctggccttcccgaatgcctacggactcaccgtccgctacgccatgaaagccagtcctaaccgccgtattctgcgtattttcaatgaaatgggactccacatcgatgccagctccggacacgaagtcgcccgcgccatggccgccggaatcccggcaacgcacatttctctcagtgcgcaggagcttccggacaacctgggcgaactcctggaccagggcatgctcttcaatgccaccagcctcaatcaaattcgaaccgcgggcgaaatccgtcccggcatccaaatcggtctgcggtttaaccccggtctcggttccggcggcaccaaccgcaccaacgtcggtggacctgccagctccttcggcatctggcatgagtacgcgccccaggccgccgacctgctggagcattaccgcctgacctgcgtgcggattcatacccacatcggcagcggcagcgatccctccgtctggcagcgcgccgccctcctcagcctcgaacaggtgcggcgctttcccgatgtgcacaccctggatatgggcggcggctttaaggtcgcccgcatgcgttctgaaaaatccacagacctccaggaggtcggggcccccgttcgtgccgcctttgaggactttgccgccgagaccggacggaaactgcatctcgaaatcgaacccggcacctacctggtggccaatgccgcctccatcatcagccgcgtacaggatgtgatcgacaccggggaagacggctatctcttttaccgcctcgacaccggcatgaccgacgtcctccgcccctccctttatggtgcgcagcatccgctggtggtcataccccgcaccgatgatcgcgactgtcccgaggtggaggtgattctcgttggccactgctgcgaatccggcgatatccttaccccggcacccggtgatcccgaggcactcgccccgaggactattcgcctggcggaagtcggcgattatgtggtcattgaaggcgtcggcgcctactgctcttccatgagcacccgaaactacaactcctttccggccagtccggaagtcctgctcacccctcacggcgaaaccgaactcattcgcaaacgtcaacccctcgaagatatttgggcactggaaatgtaa

SEQ ID NO: 766 - protein, 419 aa, Unknown
  Obtained from environmental sample
  DOMAIN (275)...(397): Pyridoxal-dependent decarboxylase, C-terminal sheet domain
  DOMAIN (29)...(272): Pyridoxal-dependent decarboxylase, pyridoxal binding domain
MHLETTRFLSAGQTRGLASTYGTPLYVYDETTLRQRAEETLAFPNAYGLTVRYAMKASPNRRILRIFNEMGLHIDASSGHEVARAMAAGIPATHISLSAQELPDNLGELLDQGMLFNATSLNQIRTAGEIRPGIQIGLRFNPGLGSGGTNRTNVGGPASSFGIWHEYAPQAADLLEHYRLTCVRIHTHIGSGSDPSVWQRAALLSLEQVRRFPDVHTLDMGGGFKVARMRSEKSTDLQEVGAPVRAAFEDFAAETGRKLHLEIEPGTYLVANAASIISRVQDVIDTGEDGYLFYRLDTGMTDVLRPSLYGAQHPLVVIPRTDDRDCPEVEVILVGHCCESGDILTPAPGDPEALAPRTIRLAEVGDYVVIEGVGAYCSSMSTRNYNSFPASPEVLLTPHGETELIRKRQPLEDIWALEM

SEQ ID NO: 767 - DNA, 744 bp, Unknown
  Obtained from environmental sample
atgagattagaaagcagtaattttaatttagttttaagtggtggagcagcgcttggctatgcacatattggagtgtgtgagtttttagatgaatacagtcttactcctaaaaactattatggggtaagtatgggcgcaattgtagcttcaattgaagccttggcactaactcttaaagagaaaaaacaaatctataaagatattagaaatatatttaagtggcttagttttaatctaagcggctctttaattagctttagaaagatagagaaaatagtagatgctatttttggttctttgcgctttagcgatttagagagagcactctatattggtgcaacagactataagaatggtgaatatgttactttttctaaagataataatactcttattaaagaggcacttttagcctctatggctgtgccagctcttttttctcctaaagagattgaaaaaagagtctatgtagatggctatattagttcaaacttgcctttatcttcaataaagaatgattatgtcaatctcattgtcaatgtaacaggaaaaaactcttttaaaaaactctcacgttcaaagcttcttaagctctctctttttagaaatttagagcgaagtattagaattttaatgtataatcaaacaaaaatggctctagaacagttctctaaagagtatattctcttagagcctaagctctcttcatataaaactacacatttttataaatttctcaaataa

SEQ ID NO: 768 - protein, 247 aa, Unknown
  Obtained from environmental sample
  DOMAIN (10)...(171): Patatin-like phospholipase
MRLESSNFNLVLSGGAALGYAHIGVCEFLDEYSLTPKNYYGVSMGAIVASIEALALTLKEKKQIYKDIRNIFKWLSFNLSGSLISFRKIEKIVDAIFGSLRFSDLERALYIGATDYKNGEYVTFSKDNNTLIKEALLASMAVPALFSPKEIEKRVYVDGYISSNLPLSSIKNDYVNLIVNVTGKNSFKKLSRSKLLKLSLFRNLERSIRILMYNQTKMALEQFSKEYILLEPKLSSYKTTHFYKFLK

SEQ ID NO: 769 - DNA, 1431 bp, Unknown
  Obtained from environmental sample
atgggtgttttcgactataaaaacctcgggaccgagggttccaaagcgttgttcgccgatgccatggcgatcacgctgtactcctaccacaacctggacaacggctttgccgtgggttatcagcacaacggttttggcctggggctgccggccacgctggtgggtgcgttgctgggcagcactgactcgcagggggtgattccggggattccctggaaccctgactcggaaaaggccgcccttgaggcggtcaacaaagccggctggacgcccatcagcgccagtaccttgggctatggcggcaaggtggatgcccggggcacgttcttcggtgaaaaggccggctacaccaccgcgcaggtggaggtgctgggcaagtacgatggtgacggcaaactgctggaaatcggtattggttttcgcgggacttcggggcctcgggaaaccttgatcaccgactccattggcgatctggtcagtgatttgctggcagcgctggggcccaaggattacgcgaaaaactacgccggcgaagcctttggcaccttgctcaaggatgtcgcggcgtatgccggcagtcatggcctgacgggcaaggatgtggtggtcagcggccatagcctgggcggcctggcggtcaacagcatggccgacttgagcggcaataaatggtcggggttctacaaggactccaactatgtggcctatgcctcgccaacccagagcagcggcgacaaggtgctgaatatcggttatgaaaacgacccggtgtttcgcgcgctggacggctcgtcgttcaacttctcgtccctgggcgtgcatgacaagccccatgagtcgacgacggacaatatcgtcaacttcaacgaccactacgcgtcgacgctgtggaatgtcctgccgttttccatcgtcaatgtgcccacctggctttctcatttgcccacggcctatggcgatggcttgacccgggtcctggactcgaaattctacgacctgaccagccgggactcgacgattatcgtggccaacctttcggacccggcccgggccaatacctgggtgcaggacctcaaccgcaatgccgagccgcacaagggcaacacgttcattatcggcagtgatggtgatgacctgattcaggggggcaagggtgtggatttcatcgagggcggcaagggcaatgacacgatccgcgacaacagcgggcataacacctttctgttcggcgggcagtttgggcaggaccgggtgattggttatcagccgactgacaagctggtgttccgggacgtggagggcagtgcggactggcgtgaccatgccaaagtggtggggggcgatacggtgctgagttttggcgcggattcggtgacgctggtcggcgttggactcgccggcgtttggggcgatggaatttccatcagctaa

SEQ ID NO: 770 - protein, 476 aa, Unknown
  Obtained from environmental sample
  DOMAIN (133)...(265): Lipase (class 3)
MGVFDYKNLGTEGSKALFADAMAITLYSYHNLDNGFAVGYQHNGFGLGLPATLVGALLGSTDSQGVIPGIPWNPDSEKAALEAVNKAGWTPISASTLGYGGKVDARGTFFGEKAGYTTAQVEVLGKYDGDGKLLEIGIGFRGTSGPRETLITDSIGDLVSDLLAALGPKDYAKNYAGEAFGTLLKDVAAYAGSHGLTGKDVVVSGHSLGGLAVNSMADLSGNKWSGFYKDSNYVAYASPTQSSGDKVLNIGYENDPVFRALDGSSFNFSSLGVHDKPHESTTDNIVNFNDHYASTLWNVLPFSIVNVPTWLSHLPTAYGDGLTRVLDSKFYDLTSRDSTIIVANLSDPARANTWVQDLNRNAEPHKGNTFIIGSDGDDLIQGGKGVDFIEGGKGNDTIRDNSGHNTFLFGGQFGQDRVIGYQPTDKLVFRDVEGSADWRDHAKVVGGDTVLSFGADSVTLVGVGLAGVWGDGISIS

SEQ ID NO: 771 - DNA, 1038 bp, Unknown
  Obtained from environmental sample
atgacaacccaatttagaaacttgatatttgaaggcggcggtgtaaaaggtgttgcttacattggcgccatgcagattctcgaaaatcgtggcgtgttgcaagatattcaccgagtcggagggtgcagtgcgggtgcgattaatgcgctgatttttgcgctgggttacacggttcgtgagcaaaaagagatcttacaagccaccgattttaaccagtttatggataactcttggggtgttattcgtgatattcgcaggcttgctcgagactttggctggaataagggtgatttctttagtagctggataggtgatttgattcatcgtcgtttggggaatcgccgagcgacgttcaaagatctgcaaaatgccaagcttcctgatctttatgtcatcggtactaatctgtctacagggtttgcagaggttttttctgccgaaagacaccccgatatggagctggcgacagcggtgcgtatctccatgtcgataccgctgttctttgcagccgtgcgtcacggtgatcgacaagatgtgtatgtcgatgggggtgttcaacttaactatccgattaaactgtttgatcgggagcgttacattgatctggccaaagatcccggtgctgttcggcgaacgggttattacaacaaagaaaacgctcgctttcagcttgagcggcccggtcatagcccctatgtttacaatcgccagaccttgggtttgcgtcttgatagtcgcgagcagatagggctctttcgttatgacgaacccctcaagggcaaacccattaagtccttcactgactacgctcgacaacttttcggtgcgttgatgaatgcacaggaaaagattcatctacatggcgatgattggcaacgcacggtctatatcgatacattggatgtgggtacgacggacttcaatctttctgatgcaactaagcaagcactgattgagcaaggaattaacggcaccgaaaattatttcgagtggtttgataatccgttagagaagcccgtgaatagagtggagtcatag

SEQ ID NO: 772 - protein, 345 aa, Unknown
  Obtained from environmental sample
  DOMAIN (8)...(195): Patatin-like phospholipase
MTTQFRNLIFEGGGVKGVAYIGAMQILENRGVLQDIHRVGGCSAGAINALIFALGYTVREQKEILQATDFNQFMDNSWGVIRDIRRLARDFGWNKGDFFSSWIGDLIHRRLGNRRATFKDLQNAKLPDLYVIGTNLSTGFAEVFSAERHPDMELATAVRISMSIPLFFAAVRHGDRQDVYVDGGVQLNYPIKLFDRERYIDLAKDPGAVRRTGYYNKENARFQLERPGHSPYVYNRQTLGLRLDSREQIGLFRYDEPLKGKPIKSFTDYARQLFGALMNAQEKIHLHGDDWQRTVYIDTLDVGTTDFNLSDATKQALIEQGINGTENYFEWFDNPLEKPVNRVES

SEQ ID NO: 773 - DNA, 1569 bp, Unknown
  Obtained from environmental sample
atgtgtcgaacatttctgacggcgatcgtctcgctgttcttcgcttcgacgatcttcgccgctcctgatcgcgtaagagttgatggtggagtgattgaaggcgttggtaggcagccatccggcgtgcgcgttttcagaggcattccgtacgcgcagccgcctgtgggcgatttgcgctggcgagagccgcagcccgtcaaaaagtggaccggcgtccgtcaggctgtgaaattcgggccgcgctgcatgcagccatcgatcttcagcgacatgatcttccgctcggacggcatgagcgaagattgcctttatttgaacgtctggacgccggccaagtcatccgccgagcgtttgccagtactcgtttacttttacggtggcggctttgtcgccggtgacggatcagaaccgcgctatgacggcgaaagcatggcggcgaaggggatcgtggtggttacggtgaactatcggcttggggtgtttggctttctggtccatcccgaattgacgaaggagtcgccgcacaaatcttccggcaattacggtttgctcgatcagagtgcggctttacgttgggtgaggcgcaacatcgccgctttcggtggcgacccgcatcgtgtgacgattgcgggcgaatcagccggttcggcatcggtcagcgcgcagatggcttcgcccttatcgagagggttgatcgccggcgcgatcggtgagagcggttctatcttgtggacgcttcgggcggtgccgcttgcgcaggctgagcaagcgggcgtcaagtttgccgccagtctcggcctttcgtcgcttgccgagttgcgtgcgatgagggcgcagcagcttctcgaggcggcgacgaaggaggggatggctgggatcgggcgtttcccgatcgcgatcgacggatatttcttcaccgagccacccgctgcgacatacgaagctggtcgacaggctcgcgtgccgcttttagtcggttggaactcggaagagatggggtgggccgcgctgttacgcgggcgagagccgactccggagaattacgcgcaggcggtgcgtgagctttatggggaccgcgccgatgaagtgctgaagttgtatccggcttcgacgcgcgaggaggtgattgcggcggcgaccgatttagccagcgatcggttcatcggctacggcacgtggaagtgggccgacttgcacagccggacgagcggacagcccgtataccgctacttttatacgcatccgcgtccgcgcgggaggatggccggcgcggggccgccagcgcgcggggcgatccattcggcggagatcgagtatgcgttaggcaacctgacggtcaacaacgtctatgaatggacacctgatgactacaaggtatcgaaagtgatgcaggaatatttcgccaatttcatcaagcgcggggatccgaatgggccggggttgcccgtctggccggcgatcaagggtggcggtccggtccaggtgatgcggctcgatgtcgagccgcgcgttgagccggagcgaaaccgcgcgcgctatctgttgctggaccagttggcggagaggtga

SEQ ID NO: 774 - protein, 522 aa, Unknown
  Obtained from environmental sample
  SIGNAL (1)...(20)
  DOMAIN (1)...(514): Carboxylesterase
MCRTFLTAIVSLFFASTIFAAPDRVRVDGGVIEGVGRQPSGVRVFRGIPYAQPPVGDLRWREPQPVKKWTGVRQAVKFGPRCMQPSIFSDMIFRSDGMSEDCLYLNVWTPAKSSAERLPVLVYFYGGGFVAGDGSEPRYDGESMAAKGIVVVTVNYRLGVFGFLVHPELTKESPHKSSGNYGLLDQSAALRWVRRNIAAFGGDPHRVTIAGESAGSASVSAQMASPLSRGLIAGAIGESGSILWTLRAVPLAQAEQAGVKFAASLGLSSLAELRAMRAQQLLEAATKEGMAGIGRFPIAIDGYFFTEPPAATYEAGRQARVPLLVGWNSEEMGWAALLRGREPTPENYAQAVRELYGDRADEVLKLYPASTREEVIAAATDLASDRFIGYGTWKWADLHSRTSGQPVYRYFYTHPRPRGRMAGAGPPARGAIHSAEIEYALGNLTVNNVYEWTPDDYKVSKVMQEYFANFIKRGDPNGPGLPVWPAIKGGGPVQVMRLDVEPRVEPERNRARYLLLDQLAER

SEQ ID NO: 775 - DNA, 450 bp, Unknown
  Obtained from environmental sample
atgacgctgttgtccgacaaagccatgcacacggggatcgccgggcgaatcccggtggttccccccctgccggcggacgtcgaattcatcctctccgcgctggaggccggtcgccacagcggcccgagtcgccgcaagcacgagcgccgcccctaccgcgtcgccgcccggctcaagctcttcagcgatgactcgaaggccgagccctggacgatctacacccgcgacgccagccaccagggcctcggcttcgtgacccgccaccgtctgccactgggctacggcggcatcgtgaccctgaccaacccccagggcaaggacgtgcagatcgactgcaccctgctccggtgtcgcgaggccgtgacggggtggttcgagggctcgctctacttcaatcgcgagcagcccggcttccaccccgacttcctcgaagtcgcgcatcacacctaa

SEQ ID NO: 776 - protein, 149 aa, Unknown
  Obtained from environmental sample
MTLLSDKAMHTGIAGRIPVVPPLPADVEFILSALEAGRHSGPSRRKHERRPYRVAARLKLFSDDSKAEPWTIYTRDASHQGLGFVTRHRLPLGYGGIVTLTNPQGKDVQIDCTLLRCREAVTGWFEGSLYFNREQPGFHPDFLEVAHHT

SEQ ID NO: 777 - DNA, 1116 bp, Unknown
  Obtained from environmental sample
atggctacatatatcgttacattagaagagggtcaaacaagagattgcctactaggttgtggcaaagtaggtaagccgcaatctgtacctgaatgcgttattgttgacaccctgcttactaagcaaacactagagggtatagatggcgttgtcagtgtaatagaggatcatcctgtgcagcctgaagaagcacgtcctactaataataactggttcctagaccgtatccacaaccaacagtcacgcagcaacacaacatacataccaacccgttcgggcaagggggtatgtatctatatcgtagatgatggtatgagagaatcacacagagatttctcaggacgtgtagcacaaacgattagaaatgtggacggtgtgtcaagggcacatggtactttggttgcaagttgtgcagcagggtctttatttggggcagcctttgaagcagaaatctatatggctgaaacattgtggacgtatgcagatacaattaaagctatggatgcttgtattgaccactatatccaaaatggacgtaaaccttccgtgttgaatttatcattcacatcaatgtcctccgcaggatatagagtagttatagacagagcttttagtgagggtatgactgttgtagcagcagcaggcaaccataacgacgattccctaaaaagattccctgcaaatcttgataacgtaatatcagtaggatgcttgactaaagatatggtaagagcttcttacagtaactacggagaactggtggatatatgggcacctggacacgatggaagagcggcgtcagccgtagataacaactcagcgagaatggccacaggcacttcatccgctgcacctgttatagctggtgtctgtgcaatgattcttgaagggaaccctaacctgacgaacgtagaggttcgtaaagaacttatgacaaatggttcattaccctttgcactaggtcgagttggatacgctcaagttacaaatacagcacctcttcccgaaccagaaccttgccctgaaccagagcctattgatacgtcagcaatagaacaagcattagcagattttaatgctgcaatgcaaaccttcatctctagtttgaataagtga

SEQ ID NO: 778 - protein, 371 aa, Unknown
  Obtained from environmental sample
  DOMAIN (71)...(328): Subtilase family
MATYIVTLEEGQTRDCLLGCGKVGKPQSVPECVIVDTLLTKQTLEGIDGVVSVIEDHPVQPEEARPTNNNWFLDRIHNQQSRSNTTYIPTRSGKGVCIYIVDDGMRESHRDFSGRVAQTIRNVDGVSRAHGTLVASCAAGSLFGAAFEAEIYMAETLWTYADTIKAMDACIDHYIQNGRKPSVLNLSFTSMSSAGYRVVIDRAFSEGMTVVAAAGNHNDDSLKRFPANLDNVISVGCLTKDMVRASYSNYGELVDIWAPGHDGRAASAVDNNSARMATGTSSAAPVIAGVCAMILEGNPNLTNVEVRKELMTNGSLPFALGRVGYAQVTNTAPLPEPEPCPEPEPIDTSAIEQALADFNAAMQTFISSLNK

SEQ ID NO: 779 - DNA, 1242 bp, Unknown
  Obtained from environmental sample
atggggaagttatttttaaaaatatgttttttcgcattagtgaccgtatgttcattcgcagcgaaaatatcatacgctgaagagaggcaacaaaataattatccaatcatattggtgaatggatttgctggatggggtagagaagaaatgcttggcgtaaaatattggggtggtgttcatgatatacaggaagatttgaaacgcaatggttatacggtacataccgcagctgttggacctgtttctagtaactgggatcgtgcatgtgaattgtatgcacaaattagcggtgggacagtagactatggtgccgtacatgctgagaaacatggacataatcgttttggcagaacttatagtggttttgcgccgaattggagtgaaacaaataaagttcatttagttggacatagcatgggtggacaaacgattagaacattagtacagctattaaaagaaggtagttttgaagaaaagaattatgtgaaaaatcacccagacatcaaaatatcaccactatttgaaggcggaaaatcatatgttcatagtgttacaacattagcaacccctcacaacggtacaacacttgcggatggtagtcttctactgccgttcgttaaagatttactcattacagctgcaagctttggaggaaacaataatttatcattatatgattttaaattggatcaatggggtataaagaaaaatgctggagagtcctttttccaatatagtaatcgtattctaaatagttcactttggaaaaatacaaaagatataagtcaatgggatttaagtacagatggtgcaaaggagttaaataattgggtaaagacgcaaccagatgtgtattatttatcctatagtggacatgcatcacaagcagcacctataacaggtttacatttaccgcatattacgatgaataaattgttgatggggaatgcatttttcttaggttcttatgcgagatatgaagaaaaccgtccgttagttgatacttcttggtggcaaaatgatggtgtagtaaatacgaattctatgattgcaccatcttctaatgttgctgtaaataataatgggtcattacagattggaaaatggaatcatatcgaaacgaaagcgaattgggatcatctcgatatggtaggattaagtgtttcagactcattaggtttttctagcattcaagagttttatagaacaattgctgaaaagctatcacgtttaccgaaatag

SEQ ID NO: 780 - protein, 413 aa, Unknown
  Obtained from environmental sample
  SIGNAL (1)...(26)
MGKLFLKICFFALVTVCSFAAKISYAEERQQNNYPIILVNGFAGWGREEMLGVKYWGGVHDIQEDLKRNGYTVHTAAVGPVSSNWDRACELYAQISGGTVDYGAVHAEKHGHNRFGRTYSGFAPNWSETNKVHLVGHSMGGQTIRTLVQLLKEGSFEEKNYVKNHPDIKISPLFEGGKSYVHSVTTLATPHNGTTLADGSLLLPFVKDLLITAASFGGNNNLSLYDFKLDQWGIKKNAGESFFQYSNRILNSSLWKNTKDISQWDLSTDGAKELNNWVKTQPDVYYLSYSGHASQAAPITGLHLPHITMNKLLMGNAFFLGSYARYEENRPLVDTSWWQNDGVVNTNSMIAPSSNVAVNNNGSLQIGKWNHIETKANWDHLDMVGLSVSDSLGFSSIQEFYRTIAEKLSRLPK

SEQ ID NO: 781 - DNA, 1290 bp, Unknown
  Obtained from environmental sample
atgaagaccttccgcctccggctgctcgtgctgttccttctggccgcgacggccggctccgcctgcttgcggggcccggccaccgaggcgcgcggcgccggattctccgccgaccgcctcgcgcgcatcgatcgggtgctgcaggagtgcgtctccgacgaggcctgcctcccgggcgtcgtcgtcctcgctgcccggcacggccggacggagtacttcagaagcttcggggtcagcgatcgggagcaggggacgccgatgcgcaccgacacgctcttccggctcgcctccatgacgaaggcggtcaccagcgtcgccgtgatgatgctgtacgaggagggtcggttcatgctgaacgacccggcgcaccggttcatccccgagctgcgcaacgcggcggtggtggaccgcgtgaagcccgacgggtcctacaccaccgtgccggcccggcgggcggtcaccatccgcgatctgctcgcgcacacctcgggcatctcgtacgggttcctcgacgagaagatgaggccgatctaccgaaaggcggcggtcgtcgacgcgttcacgaacgagccgatcacgatcggcgagtcgatgcggaagctggcggcgctgccgctggcgagccagccgggcgagcgcttcctctacggcctgaacaccgacatgctcggccatctcgtcgaggtggtctcgggcctgccgctcgatcgcttcttccaggagcgcatcttcgcgccgctgcggatgaccgacacccacttctatctgccgccggagaaggccccccgcctggcggcgctctatgccgagcaggacggccggctggtgcccgccgacgaggtgccgacgagcgccctggcggcgcaggtgacgtcgaactatccgctcgagggcgcccggacgtacttctccggcggggcggggctgacgggcaccacggccgacttcgcgcggttcctgcagatgctgctcaacggcgggacactcgacggggtgcggctgctcagccggaagtcggtcgagctgatgacgaccaaccacatcggcgacctgtcgttcacgccgggacaccggttcggcctcggcttctcgatcgccgccgatccgggcgccatcggcgagctgacgtcgaccaacgcgtacggctggggcggggcgttcttcacgcagtactgggtcgacccgcaggagcagctcgtcatcctgttcatgtcgcaggtgctcccgacgacgagacgggacgtgtggaaccggacgcgcacgctcgtgtaccaggcgctggatcactag

SEQ ID NO: 782 - protein, 429 aa, Unknown
  Obtained from environmental sample
  DOMAIN (43)...(425): Beta-lactamase
MKTFRLRLLVLFLLAATAGSACLRGPATEARGAGFSADRLARIDRVLQECVSDEACLPGVVVLAARHGRTEYFRSFGVSDREQGTPMRTDTLFRLASMTKAVTSVAVMMLYEEGRFMLNDPAHRFIPELRNAAVVDRVKPDGSYTTVPARRAVTIRDLLAHTSGISYGFLDEKMRPIYRKAAVVDAFTNEPITIGESMRKLAALPLASQPGERFLYGLNTDMLGHLVEVVSGLPLDRFFQERIFAPLRMTDTHFYLPPEKAPRLAALYAEQDGRLVPADEVPTSALAAQVTSNYPLEGARTYFSGGAGLTGTTADFARFLQMLLNGGTLDGVRLLSRKSVELMTTNHIGDLSFTPGHRFGLGFSIAADPGAIGELTSTNAYGWGGAFFTQYWVDPQEQLVILFMSQVLPTTRRDVWNRTRTLVYQALDH

SEQ ID NO: 783 - DNA, 1431 bp, Unknown
  Obtained from environmental sample
atgggtatctttgactataaaaacctcggcaccgagggttccaaagcgctgtttgccgacgccatggcgatcacgttgtactcctaccacaacctggataacggctttgccgtgggttaccagcacaatggcttggggcttggtttgccggccacgctggtgggtgcactgctcggcagcacgaattcacagggtgtcattccgggcattccctggaacccggattcggaaaaagccgcgctggaggcggtgcaaaaagccggttggacgccgatcagtgcaagtaccctcggctacggcggcaaagtcgatgcgcgcggcacgttttttggcgaaaaagccggctacaccacggcgcaggtcgaggtgctgggcaagtacgatgacgccggcaaactgctggaaatcggcatcggctttcgcggcacgtcggggccgcgggaaaccttgatcagcgactccatcggcgacctggtcagcgatctgcttgcggcgctggggcccaaggattacgcaaagaactacgccggcgaagcgttcggcgggctgctcaaaaacgtcgccgattacgccgctgcccatggccttaccggcaaggacgtggtggtcagcggccacagcctgggcggcctggcggtcaacagcatggcggatttaagcaccaacaaatggtcgggcttctacacggacgccaactacgtggcctatgcatcgccgacccaaagcgccggcgacaaggtgctcaacatcggctatgaaaacgacccggtgtttcgcgcgctggacggctcatccttcaatctgtcgtccctgggcgtgcacgacaagccccacgagtcgaccaccgataacatcgtcagcttcaacgaccactacgcctcgacgctgtggaatgtgctgccgttctccatcgtcaacctgccgacctgggtctcgcacctgccgaccgcatacggcgacggcatgacgcgcatcctcgactccgggttctatgaccagatgacccgtgactccacggtaatcgtcgccaacctgtccgacccggcgcgggcgactacgtgggtgcaggacctcaaccgcaatgccgaaccgcacaagggcaataccttcattattggcagcgacggcaacgacctgatccagggtggcaagggcgcggactttatcgaaggcggcaaaggcaatgacacgatccgcgacaacagtgggcataacaccttcctgttcagtggccagttcggcaacgatcgcgtgattggctaccagaccaccgacaagctggtgttccaggacgtgcaggggagcaccgacctgcgtgaccatgccaaagtggtcggcgcggacacggtgctcacgtttggcgccgactcggtgaccctggttggcgtcggccatggcggcctgtgggcggacggcgtcagcatcggctga

SEQ ID NO: 784 - protein, 476 aa, Unknown
  Obtained from environmental sample
  DOMAIN (133)...(265): Lipase (class 3)
MGIFDYKNLGTEGSKALFADAMAITLYSYHNLDNGFAVGYQHNGLGLGLPATLVGALLGSTNSQGVIPGIPWNPDSEKAALEAVQKAGWTPISASTLGYGGKVDARGTFFGEKAGYTTAQVEVLGKYDDAGKLLEIGIGFRGTSGPRETLISDSIGDLVSDLLAALGPKDYAKNYAGEAFGGLLKNVADYAAAHGLTGKDVVVSGHSLGGLAVNSMADLSTNKWSGFYTDANYVAYASPTQSAGDKVLNIGYENDPVFRALDGSSFNLSSLGVHDKPHESTTDNIVSFNDHYASTLWNVLPFSIVNLPTWVSHLPTAYGDGMTRILDSGFYDQMTRDSTVIVANLSDPARATTWVQDLNRNAEPHKGNTFIIGSDGNDLIQGGKGADFIEGGKGNDTIRDNSGHNTFLFSGQFGNDRVIGYQTTDKLVFQDVQGSTDLRDHAKVVGADTVLTFGADSVTLVGVGHGGLWADGVSIG

SEQ ID NO: 785 - DNA, 936 bp, Unknown
  Obtained from environmental sample
atgccactcgatcctcaaattcaagcctatctcgatcagatggcggcaatgaatatgcccccgatacatacgatgacgcccgaacaggtacgaatgggaatagcgatgcagcttgcgatggagaacattgagaaagagcaggtggctcgcgttgagaaccgcaccattcccggcccggcgggcgagatacctgtgcgcatctacacgccgcagggcaacgggcctttcccggctctggtcttctttcacggcggcggctgggtgatctgtaacctggacacgcacgatggtatctgccgcagcctggcaaacggcgcgggctgcgtggtcgtctcggtcgattaccggctcgcgcccgaacacaaatttcctgccgcgcccgaagattgctatgccgcgacgcaatgggtggcgaagaacgcggcagagttgaacgtggaggcatccaacattgccatcggcggggatagcgcgggcggcaatctcactgccgtcgtggcgcagatggcgcgagatcggggaggcccgcatctcgtcttccagttgctaatctatcccgccaccgatttcaggatgaacacgccctccatcgaagagaacgccaccggctacttcctgacgaaagacgacatgatctggttcacgaaccattacctgaacagcgaagaggataagacgaacccgctggcctcccccctgctggcgagcgatctgagcggcctgcccccggcccttatcatcaccgcccagtacgaccccctgcgcgacgagggtgagttgtacgggcagaaattacgggaagcaggcgtccccgtcaccgtcagccgctacgaaggggttattcatggctttttcggcagcattccctccgataagggcaagcaggccgaggccgaagccagcgccgccctgcgtctggcctttggcaaagcgtag

SEQ ID NO: 786 - protein, 311 aa, Unknown
  Obtained from environmental sample
MPLDPQIQAYLDQMAAMNMPPIHTMTPEQVRMGIAMQLAMENIEKEQVARVENRTIPGPAGEIPVRIYTPQGNGPFPALVFFHGGGWVICNLDTHDGICRSLANGAGCVVVSVDYRLAPEHKFPAAPEDCYAATQWVAKNAAELNVEASNIAIGGDSAGGNLTAVVAQMARDRGGPHLVFQLLIYPATDFRMNTPSIEENATGYFLTKDDMIWFTNHYLNSEEDKTNPLASPLLASDLSGLPPALIITAQYDPLRDEGELYGQKLREAGVPVTVSRYEGVIHGFFGSIPSDKGKQAEAEASAALRLAFGKA

SEQ ID NO: 787 - DNA, 642 bp, Unknown
  Obtained from environmental sample
atgatgacctattcaacacaaaagatgtctatgctggcgttgctggcatccctactgtttgctggctccgccaatgccgcctgtaacgcagatcctatcgtattcattcacggctattcaggctggaaatcccagtttgatgtgatgatcaaccgcttcaagaatgacggcactccggcctgtgcgatgtacaagttcggatacaacagtcttctgaagagcaacaagaccagcgccaaagagctgagatcattcattaatggtattcggcccaatcatggcaaccgtcaagcgaaaattattgcgcactccaacggtggcctggtctcgcgctggtatcgtgtcttcgagggtggttcttccgcaactagccgtctggtcacgctgggcactccccacaaaggtactgcctgggcctatggctgcttcagccctgcctgctccgagatgcgttacaactcggacttcctgaagtcgctgaacgggcgtggttgcgatgtgtcgctatggtcggcattggatgaaatcatcatcccgcaaagcaatgcccagtgcggcaatagccgccagacctccagtgtgggtcacttgaccctgatggtctgggaaggcgtctacaaagacgttagacgctatctgtaa

SEQ ID NO: 788 - protein, 213 aa, Unknown
  Obtained from environmental sample
  SIGNAL (1)...(26)
  DOMAIN (30)...(211): Lipase (class 2)
MMTYSTQKMSMLALLASLLFAGSANAACNADPIVFIHGYSGWKSQFDVMINRFKNDGTPACAMYKFGYNSLLKSNKTSAKELRSFINGIRPNHGNRQAKIIAHSNGGLVSRWYRVFEGGSSATSRLVTLGTPHKGTAWAYGCFSPACSEMRYNSDFLKSLNGRGCDVSLWSALDEIIIPQSNAQCGNSRQTSSVGHLTLMVWEGVYKDVRRYL

SEQ ID NO: 789 - DNA, 1134 bp, Unknown
  Obtained from environmental sample
atgaatactcaatgtccgattgtattggtgcacggcatcctgggctatggctccagggagctcttgggattctcttactgggggcaggcgctgcaggcgccgagcccggtgccggtgcttgaggcatcggtcggtcctctttcgtcccatcatgatcgggcgtgcgagctttacgcgcaaatcaagggcttgccggtggattacggcgaggaacatgccgcaggcgccgggcatgcccgtttcggcaaggactacaccggtcgagggctttatccgcaatggtccgcggaaaatccgattcatctggtcggccattcgatgggcgggcccaccatccgcatgcttcagcatttgctggacataaaattttggcagaaagacaacagcgcctcctggatcaaatcggtgaccggcatttccggcgtgttcaacggttccaccttgacgcatatgttttgcgacgctgaaacaggaaaggtcaccaagcctctcggtgcggtgttgggcaaggtcgccaattttgccgccggcattgtgggttcaaaactggaccggctatacgatttcgatctggaacactggggattgacaagaaagtccggcgaaagcctggtcgattatctggctcgaatcgaccagtccaggctcttcagggagatcgataatgccgtctacgaccttacgattcacgccgcgctggaactgaacgcattgattccgacttttcccgagacctattatttttccttcgtcaccgaaaataccagcgctttgccgctgttgcgccttcatgggccgggcacggatatcagcgggctttttcttgccagctccgcctacatgggcatgtatccgttttttccgaaattttacgagggcttcaacagcgccgactggcgcgaaaacgacggcgccgtgccgtcttattcgcaaatgtatcccagactctccggcaggcatctggtcggcggagacctggacaccggcgaaggggaatttcagccggggcaatggtactggaaatacctgcacgaccgcgatcatctgaatgtggtgatgcttccgaaaccgttccaggcggattggcaaaaagcgttttatgccgatttgtttaatatgctggctgggttgtga

SEQ ID NO: 790 - protein, 377 aa, Unknown
  Obtained from environmental sample
MNTQCPIVLVHGILGYGSRELLGFSYWGQALQAPSPVPVLEASVGPLSSHHDRACELYAQIKGLPVDYGEEHAAGAGHARFGKDYTGRGLYPQWSAENPIHLVGHSMGGPTIRMLQHLLDIKFWQKDNSASWIKSVTGISGVFNGSTLTHMFCDAETGKVTKPLGAVLGKVANFAAGIVGSKLDRLYDFDLEHWGLTRKSGESLVDYLARIDQSRLFREIDNAVYDLTIHAALELNALIPTFPETYYFSFVTENTSALPLLRLHGPGTDISGLFLASSAYMGMYPFFPKFYEGFNSADWRENDGAVPSYSQMYPRLSGRHLVGGDLDTGEGEFQPGQWYWKYLHDRDHLNVVMLPKPFQADWQKAFYADLFNMLAGL

SEQ ID NO: 791 - DNA, 801 bp, Unknown
  Obtained from environmental sample
atgccaactgtgaaggtcaatgatatcgcactatattacgaagaccgcggtgagggagagccgctgatactgatccacggcctcggctccagcgcactggattggaagccacaactggacgacctgtcccgcgactaccgcgtgattgctctggatttgcggggacacggtcgttccgagcgcctgaaaaatggctacagcttaccgctgttcgccagtgacgttgccggcgtgctgcagacgctgaatatcgaatcagcgcacattgtcggcctgtcactgggtggctgcgtcgcatttcaattggcggttgatcggccagagttggtgcgcagtctgagtatcattaatagcggcccatcgcttgtgctggatacccccttgcgaaagcttgtcgtgtggtggcggtttgcactcataaacctgttcggtttgccagtgttaggcaaggtggtggcgcgccgtctgtttcccgatgctacgcaggaggaactgcggaggaccttcgtagaacgcttcgccgacaatgacccgcatatatataagcagagcctgaaagccctggtcggctggagtgttcgtgatcgacttggtgatatccgggtgccagtgctggtgttggcggccgaccaggactatacaccggtatcgatgaaggaggaatttgtccccctgatcccgcaggcgcacttgaaagtcattcccgatgcccaccacgccgcccccatggaatgcccggataaggtcaatcgcatgctgcgcgaatttctggaaggcctccccgcgatgggcacaaaatga

SEQ ID NO: 792 - protein, 266 aa, Unknown
  Obtained from environmental sample
  DOMAIN (46)...(255): alpha/beta hydrolase fold
MPTVKVNDIALYYEDRGEGEPLILIHGLGSSALDWKPQLDDLSRDYRVIALDLRGHGRSERLKNGYSLPLFASDVAGVLQTLNIESAHIVGLSLGGCVAFQLAVDRPELVRSLSIINSGPSLVLDTPLRKLVVWWRFALINLFGLPVLGKVVARRLFPDATQEELRRTFVERFADNDPHIYKQSLKALVGWSVRDRLGDIRVPVLVLAADQDYTPVSMKEEFVPLIPQAHLKVIPDAHHAAPMECPDKVNRMLREFLEGLPAMGTK

SEQ ID NO: 793 - DNA, 780 bp, Unknown
  Obtained from environmental sample
atgtcccgttttcaactttgggctctgaccgtgctggtcacgatcgggctggctcgttccgtaaacggtcaagaggatttgacgtttgacgttggaggcgagaagttcgtcgtcaaaagatacccggaaaatcctgacgccatgaaacggcccgtggttattctcgtgcatggaatcgatggcatgggcggcgcctccggggttcagatcaagagctttgccgaggaactcgctaaaggaggatacctggccctggttccccagtacttcggtaagaacgacggctccgactcggacgagttcaacaagcttatcgagttgcgtctcgggaaattcgatgattatgtcccgcgtatcgccgccgtagtgcaaaccgccatggaccaaagcgatgccgatggggatcgccttggactggttggcttctcccttgggggagggctggtactcaagcaagcgcagtcagcccccgctgacaagatcaaggcagtcgtgaacttctacggttacatcccgaattctggtattttcatgaatgccgacaagcttcctccgacgctgatcctacataacaagaacgatagggttgtgaagatcggcgtctccgaggctctactccgcgccttgaagaaaacgagtgtgaagcacgatcatcgcttctacgatgaggagtattttttccgactccaccacacgtttcgtcctgggggcaacgccgatgtcgattcccgaaaacggactctcgactggctaaattcgcatctcaaggcgtcgaactga

SEQ ID NO: 794 - protein, 259 aa, Unknown
  Obtained from environmental sample
  SIGNAL (1)...(23)
  DOMAIN (38)...(255): Dienelactone hydrolase family
MSRFQLWALTVLVTIGLARSVNGQEDLTFDVGGEKFVVKRYPENPDAMKRPVVILVHGIDGMGGASGVQIKSFAEELAKGGYLALVPQYFGKNDGSDSDEFNKLIELRLGKFDDYVPRIAAVVQTAMDQSDADGDRLGLVGFSLGGGLVLKQAQSAPADKIKAVVNFYGYIPNSGIFMNADKLPPTLILHNKNDRVVKIGVSEALLRALKKTSVKHDHRFYDEEYFFRLHHTFRPGGNADVDSRKRTLDWLNSHLKASN

SEQ ID NO: 795 - DNA, 948 bp, Unknown
  Obtained from environmental sample
atgtctgagcccttcatccgccccgacgttcgcatcttcctcgattatctcaacagcctgccggggccgcgctctcatcaggttgggccggcggaggcgcggtcgatgatgcacgcctcccgccatgtcgccgacgggccggcgggcgaactggcggtgatccgcgacctgaactgccccgggcctgggggcgacatcccgcttcggctgtacgacgcgcgggagagccgcgaggcggggccgctgctggttttcttccacggcggcggcttcgtgcttggcgacctcaacacgcacgagcccttttgcgccgagatcgcgcggctgctcgacctgccggtggtggcggtggattaccggctcgctccggagcatccctggccggcgggggccgaggattgcatcgccgcggcgcgctggctggcgacaagtccggccgctctcagtcgcgaggtaaccggcctcattatctgcggcgacagcgccggcggcaatttcgcgatcgtgacgacactctccttgagagacgagccggcggcggtgccggtgatcgcgcaatggccgatctatccggccgccgatccggccaagggctacccctccttcgaggacttcgccgaaggctacctgctgacccgcgaaggcatgaagtggttcgacgaatgctacgccgccgatgcgaaagactggcgctattcgccgttggtcaagagccaggaggggatgccgcccactttggtggtaacggccagcctagacccgatccgggaccagggccgcgcctatgccgccgcctgcgtccaggccggggtgccgacggtgttccgcgaggcgagagggacgatccacggcttcatcaaccttcgcaaggcgatcccctccgcccaggccgatatcgagggatgcgtcgcggccctgaagctgatgatcgacgaggcgcggagatga

SEQ ID NO: 796 - protein, 315 aa, Unknown
  Obtained from environmental sample
MSEPFIRPDVRIFLDYLNSLPGPRSHQVGPAEARSMMHASRHVADGPAGELAVIRDLNCPGPGGDIPLRLYDARESREAGPLLVFFHGGGFVLGDLNTHEPFCAEIARLLDLPVVAVDYRLAPEHPWPAGAEDCIAAARWLATSPAALSREVTGLIICGDSAGGNFAIVTTLSLRDEPAAVPVIAQWPIYPAADPAKGYPSFEDFAEGYLLTREGMKWFDECYAADAKDWRYSPLVKSQEGMPPTLVVTASLDPIRDQGRAYAAACVQAGVPTVFREARGTIHGFINLRKAIPSAQADIEGCVAALKLMIDEARR

SEQ ID NO: 797 - DNA, 900 bp, Unknown
  Obtained from environmental sample
atgaaggcaagctgccgcgacatcgaaatcgaatacgaaacattcggccatccggacgacccggccatcgtgctgatcatgggactcggtggccagctcatcctgtggccggaagcgttctgccgcatgctggccgacgctggtcactacgtggtgcgcttcgacaaccgcgacatcggcctgtcgacgcatctcgatcaccttccccgccccaacctgccgctcgccgcgctccgccaggcgctgcgcctgccagttcgcgccagttacacgctcgacgacatggcggacgacgtcgcgggcctgcttgatgcactgaacatcaagcaggcgcacgtcgtcggcgtgtcgatgggcggcatgatcgcccagctgctggccgcacggcacgcgacccgcgtgcgcagcctgaccttgctgatgaccaccagcggcgcgcgcaacgttccgggcccctcactcggcatgcgcatggaaatgatccgtcgaccgcgcgacacctcgcgcgaggggctgatccgccatggtatgcgtacctggcggatcatcggcagcccgacgtacccgaagccggaagccgaactgcgccgcatcgtcgccgagggctttgaccgcgcgtttcacccggccggtttcatgcgccagctgcacgccgttctcgcggcaccgagccgcgcacccctgctgccgcgcatcaaacagccggccgacgtcattcacggcgacgccgacctgctggtaccagtggcagcggcacgtgatctggtgcgccgcctgccgaacgccacgctcgacatcgtgccgggcatggggcatgacttcccgaccgagatcatgccgcgtatcgcgcgccgcattgtcgaaaccgcggcacgcgacccgcagcggctcgccgcctag

SEQ ID NO: 798 - protein, 299 aa, Unknown
  Obtained from environmental sample
  DOMAIN (49)...(288): alpha/beta hydrolase fold
MKASCRDIEIEYETFGHPDDPAIVLIMGLGGQLILWPEAFCRMLADAGHYVVRFDNRDIGLSTHLDHLPRPNLPLAALRQALRLPVRASYTLDDMADDVAGLLDALNIKQAHVVGVSMGGMIAQLLAARHATRVRSLTLLMTTSGARNVPGPSLGMRMEMIRRPRDTSREGLIRHGMRTWRIIGSPTYPKPEAELRRIVAEGFDRAFHPAGFMRQLHAVLAAPSRAPLLPRIKQPADVIHGDADLLVPVAAARDLVRRLPNATLDIVPGMGHDFPTEIMPRIARRIVETAARDPQRLAA

SEQ ID NO: 799 - DNA, 1245 bp, Unknown
  Obtained from environmental sample
atggattcggctgaactgcgccgggcgatggagggtcaggtgcagaaagtggggctgcgcttcgaggccgacctgagcaatacgatattggacgatgtccagggtgaaccgggggccatgccgctgctgcagcacgcactgctggagctgtggaagaggcgccacggccggtggctcctgagcagcgagtatcgggaaaagattggcggtgtcaagcaggccatcgcccgcacggcggatgagatttatgaacattcttcaaaagaagaccaggaacggatgcgcaacatcttcatccggctcaccaggcttggtgatgagaccgcttcggagcaggagcaacgcgacacccgtcgccgacgcgcgatgtgggagttggagtcagaaggagacagcctggaaactgtcaggaaacttgtgcatcgtcttggttcagaaaatgcacgcctggttgtaataaaagagaaagagctgggtgccaggctggaagaggccgaagtcgaagtagcccatgaggccttgatccgtcactggccaagattgcgacaatggctgaatgaagaccgggtcagctaccggctacgcgacaccatcagcgaggataccaaggagtgggagaaatccggcaatgacgataacctgctgccgcgctggaatagcaaactggaggcggcgctggaactttcccgaggaagaccgggctttttcaccaaactggagaaggagtacctggattcctgtggtaagctgcgggacaaggaaacattggagcgtgagcaacgagagacggaactcagaaccgctttggcagaagcccaacaccaaggccgaatcgctacggcgcgccatctggcgacccaatcacaagctacactatcaagttaccctcagcgaagcctgcttctcgccatcgaggctgttgcaacttccacgcgggcaggtgaaattcgagttccagtagctgaagaaggactgcggcaggcacttgctaatattggggggctatgcctgagtggccaccatggtccagtcaacgccgttgccatcagcgccgacaatcgccggctggtgaccggaagttttgataacacggcgcggctgtgggacttgtccctggatgagcaggttaaactggcctgccgcacggccggccgaaatttgagcattgaggagtggcaacaatacatgggggaccaaccctaccgggaaacctgttccgaaaaccttgaaggttctcgcaagtag

SEQ ID NO: 800 - protein, 414 aa, Unknown
  Obtained from environmental sample
  DOMAIN (332)...(369): WD domain, G-beta repeat
MDSAELRRAMEGQVQKVGLRFEADLSNTILDDVQGEPGAMPLLQHALLELWKRRHGRWLLSSEYREKIGGVKQAIARTADEIYEHSSKEDQERMRNIFIRLTRLGDETASEQEQRDTRRRRAMWELESEGDSLETVRKLVHRLGSENARLVVIKEKELGARLEEAEVEVAHEALIRHWPRLRQWLNEDRVSYRLRDTISEDTKEWEKSGNDDNLLPRWNSKLEAALELSRGRPGFFTKLEKEYLDSCGKLRDKETLEREQRETELRTALAEAQHQGRIATARHLATQSQATLSSYPQRSLLLAIEAVATSTRAGEIRVPVAEEGLRQALANIGGLCLSGHHGPVNAVAISADNRRLVTGSFDNTARLWDLSLDEQVKLACRTAGRNLSIEEWQQYMGDQPYRETCSENLEGSRK

SEQ ID NO: 801 - DNA, 960 bp, Unknown
  Obtained from environmental sample
atgagaaagatgttggcggtcggatttggtctcattgctgtatttgttttattgatcgcagggatttatttcctgttcccggaaacattgttcaacctggcgctgcaagctcaaagacactcttccggcctggccaggaaggaaatccaggtggatgatcataaaatcgtgtatctggaaggaggaaaagggcaatcgatattattgcttcatggctttggagcaagcaaggacgactgggcacaattcgcaaagtacctgacaggcgactatcacgtggtgatccctgatattccaggttttggcgaaagctctcagatacagaaagcaagttatgatacggaaaaccaaatgaagcgcatcgaccggtttacggagataatgaaactcgaaagatttcatctggcaggaaattccatgggagggatgcttgctgcagcgtatggggcaaactatccccagaaggttgctacgctggcgctgttggcgccgggtggcgtcaaatctccaaaaataagcgagatggccatgctgatacagaaggggacaaatcctttactggcaggcagtcccgaagattttgataaactgctaaaattattgtttgccaaacctccgttcatcccttcccagtttaaaaaagttttcgccgccgatgctattgcgcacagtgattttaataaaaaaatattggacgatatgaaatgggatcacacaggagcgacgccgtctccaatggaaacttttctggatccttatttgcctcagattcaggcgccggttttgattatctggggcgataccgacaagattctggacgtgggaggcgttgcggttttagaaaagaatttgaaaaattacaaaaccgtcatcatgaaagatacaggacatatccccatgttggaaaatccgcaggagacagcagcacactatgtaagctatctgaaggggaaaaagtaa

SEQ ID NO: 802 - protein, 319 aa, Unknown
  Obtained from environmental sample
  DOMAIN (91)...(313): alpha/beta hydrolase fold
MRKMLAVGFGLIAVFVLLIAGIYFLFPETLFNLALQAQRHSSGLARKEIQVDDHKIVYLEGGKGQSILLLHGFGASKDDWAQFAKYLTGDYHVVIPDIPGFGESSQIQKASYDTENQMKRIDRFTEIMKLERFHLAGNSMGGMLAAAYGANYPQKVATLALLAPGGVKSPKISEMAMLIQKGTNPLLAGSPEDFDKLLKLLFAKPPFIPSQFKKVFAADAIAHSDFNKKILDDMKWDHTGATPSPMETFLDPYLPQIQAPVLIIWGDTDKILDVGGVAVLEKNLKNYKTVIMKDTGHIPMLENPQETAAHYVSYLKGKK

SEQ ID NO: 803 - DNA, 1146 bp, Unknown
  Obtained from environmental sample
gtgcagatccagggtcactatgagctgaagttcgaggcagtgcgtgaagcgttcgccgcgttgttcgatgatccccaggagcgtggcgctgcgctgtgcatccaggtgggcggggaaaccgtggtcgacctctgggcgggcagcgccgacaaggacggccagcaggcctggcacagcgataccatcgccaacttgttctcctgcaccaaaaccttcacggccgtcaccgcgctgcaactggtgggcgaaggcaagctggctttggacgccccggtagcgcgctactggccggagttcgcccaggcaggcaaggaatctgtcaccctgcgccagttgctcagtcaccgtgccggtctgccggccatccgcgaactgctgcccgccgaggccctgtacgactggcaaaccatggtcgataccctggccgccgaggcgccttggtggacaccaggtaccgagcatggctatgccgccatcacctacggttggctgattggcgagctcattcgtcgggtcgacggccgtgggccgggcgagtcgatcgtagcccgcaccgcccggccattggggctggactttcacgtcggcttggccgatgaagaatttcatcgtgtagcgcacatcgcccgtggcaaaggcaacgccggtgatgccgccgcccagcgcctgctgcaggtcaccatgcgcgaacccgaggcgctgagcacccgcgcattcaccaacccgcctgcgatcctgaccagcaccaacaagcctgagtggcggcgtatgcagcagcctgcagccaatggccacggcaatgcccgcagcctggcgggtttctacgccggcctgctggacggcagcctgctggagtccgagctgcttgacgagctgacccgcgagcacagcctcggccaggaccgtaccctgctgactcagacgcgattcggtctcggttgcatgcttgaccagcccgatgtggcaaatgccacgttcggcctcggctccagggcctttggtcacccaggggcaggtggttccgtcggatttgctgacccggaacacgacgtttccttcggttttgtggtcaataccctcggcccctacgtgctaatggaccctcgtgcccagaagctggtccgggtgttgggcagttgcctttga

SEQ ID NO: 804 - protein, 381 aa, Unknown
  Obtained from environmental sample
  DOMAIN (14)...(376): Beta-lactamase
MQIQGHYELKFEAVREAFAALFDDPQERGAALCIQVGGETVVDLWAGSADKDGQQAWHSDTIANLFSCTKTFTAVTALQLVGEGKLALDAPVARYWPEFAQAGKESVTLRQLLSHRAGLPAIRELLPAEALYDWQTMVDTLAAEAPWWTPGTEHGYAAITYGWLIGELIRRVDGRGPGESIVARTARPLGLDFHVGLADEEFHRVAHIARGKGNAGDAAAQRLLQVTMREPEALSTRAFTNPPAILTSTNKPEWRRMQQPAANGHGNARSLAGFYAGLLDGSLLESELLDELTREHSLGQDRTLLTQTRFGLGCMLDQPDVANATFGLGSRAFGHPGAGGSVGFADPEHDVSFGFVVNTLGPYVLMDPRAQKLVRVLGSCL

SEQ ID NO: 805 - DNA, 777 bp, Unknown
  Obtained from environmental sample
atgaaaataggtattgctctttcaggaggtgggacaagaggaattgctcatttaggggtaattaaggcgttaatggaaaataatatccagatcagctctatttccggagttagtgcaggggcaattgtggggggatttatttcatatggttatcaccctgaagaagtacttgaaatcattcttaaaacacgattatttaaatatctgaggcccgggataagtagtacaggattacttaagcttgaacagctgcaggttctattaaaacagtatataaaagaagatttatttgaggatttaaaaattcctttaactgtatcggccttaaatcttaaaacaggaagaattaattattttgattcaggtcctcttattgcccccatcctagcttcctcctccatcccagttatttttaatccgattttgattaatggaatacagtttatcgatggaggattagcggaaaatttacctgttagtccattaaaagggtctgttgactttatacttgcttcccattgcaatccaattaatacagagattcaaaggcttactatcagaacctatatcgaaaggttgttactgattaccattaataacaatgctcaacactcgttgaaggaagtagatttcgtaattgagccacctgaactaaaaaatatcagatggtctgattcttcaaaggctaaattgatatttgagatggggtatcaacacacattggaggtaatcccagcattaaagaaaaaaacaagagagttaaatctcgatatttag

SEQ ID NO: 806 - protein, 258 aa, Unknown
  Obtained from environmental sample
  DOMAIN (5)...(163): Patatin-like phospholipase
MKIGIALSGGGTRGIAHLGVIKALMENNIQISSISGVSAGAIVGGFISYGYHPEEVLEIILKTRLFKYLRPGISSTGLLKLEQLQVLLKQYIKEDLFEDLKIPLTVSALNLKTGRINYFDSGPLIAPILASSSIPVIFNPILINGIQFIDGGLAENLPVSPLKGSVDFILASHCNPINTEIQRLTIRTYIERLLLITINNNAQHSLKEVDFVIEPPELKNIRWSDSSKAKLIFEMGYQHTLEVIPALKKKTRELNLDI

SEQ ID NO: 807 - DNA, 873 bp, Unknown
  Obtained from environmental sample
atgctcccccgcgccgccactcttttttccctcctcctcctcagcaacctcgcatacgcccaggaagtcatccgcctttacgacggccccgcgcccggaagcgagacctggacccacgaagaaaaggaattcttctcgaccgcctggaataccgacgtcgtcaccaatgtcgtcaacccgaccctgaccgcctacctgcccgaccccgcccaagccaccggcaccgccgtcatcatcgcgcccggcggcggcttttacgggctgtccatcaactccgagggtgccgaagtcgcccaatggctcagtgagcgcggaatcgcaggattcgtccttcgctacaggctggtcccgaccggagaagatggcacaaaggaattttcagacaacttcactgccgatcggcccaaggtgttgcagaaaatcatgcccgtactgcccctggccggcgccgacggcctcgccgccgtccgctacgtccgcgaaaacgcggaacggtttggcgtcgcgcccgaccgcatcggcttcatgggattctcagccggcggcggcgtgaccatgtacgtcgccaaccactacgaacccgcgagccggcccgacttcatcgcgcccatctacgccggcggcgcgcgcgtcaatgacgtgcctgccgatgcgcccccgatcttcgtcgtcgccgcctcggacgatgaactgggcctcgccgccgacagcgtcgccctctacagcaagtggctcgaggccggcaagcccgccgaactccacatatacatgcgcggcggccacggtttcggcatgcgccgccagaatctccccaccgacacctggatcgaccgcttcggcgactggctccagacgcagggcttcctcaactag

SEQ ID NO: 808 - protein, 290 aa, Unknown
  Obtained from environmental sample
  SIGNAL (1)...(20)
MLPRAATLFSLLLLSNLAYAQEVIRLYDGPAPGSETWTHEEKEFFSTAWNTDVVTNVVNPTLTAYLPDPAQATGTAVIIAPGGGFYGLSINSEGAEVAQWLSERGIAGFVLRYRLVPTGEDGTKEFSDNFTADRPKVLQKIMPVLPLAGADGLAAVRYVRENAERFGVAPDRIGFMGFSAGGGVTMYVANHYEPASRPDFIAPIYAGGARVNDVPADAPPIFVVAASDDELGLAADSVALYSKWLEAGKPAELHIYMRGGHGFGMRRQNLPTDTWIDRFGDWLQTQGFLN

SEQ ID NO: 809 - DNA, 1425 bp, Bacteria
atgggtatctttgactataaaaacctcggtaccgaggactccaaggcgctgttcgccgatgccatggcgatcacgctgtattcctaccacaacctggataacggctttgccgtcggctaccagaacaacggcctcggcctgggcttgcccgccacgctggtcagcgcgctgattggcggcagcaacgcccaaggggtcatccccggcatcccctggaatcccgactcggaaaaagctgccctcgacgcggtgcagaaagccggctggacgcctatcagcgccagtaccctgggctacagcggcaaggtcgatgcgcgcggcaccttctttggcgaaaaattcggctacggcacggcgcaggccgaggtgctgggcaagtacgatgacgctggcaagttgctggaactcggcatcagttttcgcggcacttcggggcctcgggaaagtgtgatcaccgattccatcggcgacgtgatcagcgacctgctcgccgccttcgggcccaaggattatgccaagaactacgcgggcgaggccttcggtggcttgctcaagaacgtggcggactatgccagtgcccagggcctgggcggcgatgacgtagtagtcagcggccacagcctgggcggcctggcggtcaacagcatggccgacttgagcgacagcacctggtcagggttttataaggactccaactacgtggcctatgcttcgccgacccaaagcgccggcgacaaggtgcttaacgtcggctatgaaaacgacccggtgttccgcgccctggatggctcgtcattcaacctgtcgtccctgggcgtgcacgacaaaccccacgaatcgagcaccgacaacatcgtcagcttcaacgaccactacgcctcatccctgtggaacgtgctgccgttttccatcctcaacctgcccacctgggtctcgcacttgcccaccggttacggcgacggcatgacccgcatcctcgactcgggcttctacgagcagatgacccgcgactccacggtgatcgtcgccaacctgtccgaccctgcacgggccaccacctgggtgcaagacctcaaccgcaatgccgaggcgcacaagggcaataccttcatcatcggcagtgacggcgacgacctgatcaaaggcggcaggggcgcggactttattgaaggcggcaagggcaatgacacgatccgcgacagcagcgggcataacacgtttttgttcagcgggcagtttggcaacgaccgggtgattggctatcaggcgacggacaagctggtgttcaacgacgtggcgggcagcaccgattaccgcgatcacgccaaagtggtgggcggggataccgtcattagctttggtacggattcggtgacgctggtgggtgtgagcagtctgtcgggggaggggatagtcatcagctaa

SEQ ID NO: 810 - protein, 474 aa, Bacteria
  DOMAIN (133)...(265): Lipase (class 3)
MGIFDYKNLGTEDSKALFADAMAITLYSYHNLDNGFAVGYQNNGLGLGLPATLVSALIGGSNAQGVIPGIPWNPDSEKAALDAVQKAGWTPISASTLGYSGKVDARGTFFGEKFGYGTAQAEVLGKYDDAGKLLELGISFRGTSGPRESVITDSIGDVISDLLAAFGPKDYAKNYAGEAFGGLLKNVADYASAQGLGGDDVVVSGHSLGGLAVNSMADLSDSTWSGFYKDSNYVAYASPTQSAGDKVLNVGYENDPVFRALDGSSFNLSSLGVHDKPHESSTDNIVSFNDHYASSLWNVLPFSILNLPTWVSHLPTGYGDGMTRILDSGFYEQMTRDSTVIVANLSDPARATTWVQDLNRNAEAHKGNTFIIGSDGDDLIKGGRGADFIEGGKGNDTIRDSSGHNTFLFSGQFGNDRVIGYQATDKLVFNDVAGSTDYRDHAKVVGGDTVISFGTDSVTLVGVSSLSGEGIVIS

SEQ ID NO: 811 - DNA, 750 bp, Unknown
  Obtained from environmental sample
atgtcaggcaagtacactgttttggaaggcgctgaaccgttttattttgaaggaagcagagttgggattcttgtgtcgcatgggtttaccggcagcacccaaagcatgaggccgcttggggaagcctatgcaaaggcaggttatacggtttgcggcccgcgtctgaaggggcatggcacccattacgaggagatggaacagactacatataacgattggattgattcagtcgaggaaggctaccagtggctgaaggaacgctgcgatacaatatttgtaactggtttgtccatgggcggaacccttaccctgtatatggctgaaaatcatcctgaaattaaggcaatcataccaattaatgcagctattcaaatttccgacatggccgctgcagccaaccttgatggagtgcgattccttgatgcgattggttccgacattaagaagcagggtgaaaaagagctcgcttacgagaaaactcctgtaaagtcccttggtgagatcgtagcgttaatggaaaaggttaaagctgacctttccgatatcacttgtccagcacttatttttgtttcaaaggaagatcacgttgtgccgccagataactcaaggattatcaaggaacaaatccgttctgccgataagagcctgattgagctgtcagaaagctatcatgttgccacactggacaatgaccaggagatcattatcaaggaaacattaaaattcattgaggaacagcttgggaaataa

SEQ ID NO: 812 - protein, 249 aa, Unknown
  Obtained from environmental sample
MSGKYTVLEGAEPFYFEGSRVGILVSHGFTGSTQSMRPLGEAYAKAGYTVCGPRLKGHGTHYEEMEQTTYNDWIDSVEEGYQWLKERCDTIFVTGLSMGGTLTLYMAENHPEIKAIIPINAAIQISDMAAAANLDGVRFLDAIGSDIKKQGEKELAYEKTPVKSLGEIVALMEKVKADLSDITCPALIFVSKEDHVVPPDNSRIIKEQIRSADKSLIELSESYHVATLDNDQEIIIKETLKFIEEQLGK

SEQ ID NO: 813 - DNA, 1116 bp, Unknown
  Obtained from environmental sample
atgataacaacaaacagattcctgatcctgctcctcggctccctgctgttttacggttgcagcgagagggtggatgccccgacgccaactccggagccagcggtgctggcagacttcagtggtctggatgagggttggaacaggattgagcccggtggtggcacggtatgctccgatgggtcgccctatcattttcatgtgcgggccggggatccggaaaaactcatgttctatctggaaggtggtggcgcctgctggatgggtctgaactgtgatccaacgctgcagcccagttaccagatcaatcttgccaacacagatccgtcccgtgctcatggcatttttgcctttgatctgccccggaatccgttcgctgactacacagtggtcatggcaccttactgttcaggcgatgtgcatctgggtgatgtcgagcagacctacccggtgcctgcggtgaacgggcgcgatgccggtgaggtgcatgtccgccatcgtggctgggcgaatgcacaggcggccatgaactgggctttcgaccacgtttttgcgccacagactgtatttgtcaccggctccagcgccggttcgattcctgcaccattctatgcggtaaagatggccgagcggtacgacagcgcccgtgttgtggcgctgggtgacgggtccggaggttatcgcggattcggtaatttcacgcctcatgaggcttgggccatcggcaatgtgatcagtgatcttgagtacacacgcaatatctcgccagaggctttcagcttccaccacctgtatattgcagctgcccggcagaacccttcaatcatgctgtcttccttcgacacggctgaagatgatgttcagaaacgtttcctggcgttgggtggtgcacctgccgaagcgctgcagccgttactggaaaccaatctggaggaaatcagcgagcaggcgccacagttccggtattttgtggctggtggcgacatgcataccattctgctgcgcccggagacctacagttattccaccaacggtgtgcgctttgttgactggctggccgggctcgccaatggcgagccggtggacaacgtcatgtgtggcgactgcagtcaaccctga

SEQ ID NO: 814 - protein, 371 aa, Unknown
  Obtained from environmental sample
MITTNRFLILLLGSLLFYGCSERVDAPTPTPEPAVLADFSGLDEGWNRIEPGGGTVCSDGSPYHFHVRAGDPEKLMFYLEGGGACWMGLNCDPTLQPSYQINLANTDPSRAHGIFAFDLPRNPFADYTVVMAPYCSGDVHLGDVEQTYPVPAVNGRDAGEVHVRHRGWANAQAAMNWAFDHVFAPQTVFVTGSSAGSIPAPFYAVKMAERYDSARVVALGDGSGGYRGFGNFTPHEAWAIGNVISDLEYTRNISPEAFSFHHLYIAAARQNPSIMLSSFDTAEDDVQKRFLALGGAPAEALQPLLETNLEEISEQAPQFRYFVAGGDMHTILLRPETYSYSTNGVRFVDWLAGLANGEPVDNVMCGDCSQP

SEQ ID NO: 815 - DNA, 849 bp, Unknown
  Obtained from environmental sample
gtgcaagacctccgtagaattatgaaggagtacagattcccggaaaccccagaagaggtcgaatcaactaaggattattacttggaacagaacggcgaaagaatcaggatgaggctgtacaccccaataggaggctccgactcccttatagtgtattaccatggcgggggctttgtattcggggacataaaactctatgacaatgtatgcaggaagatcgcgacaagatcatcctccaaggttctctctgtaaagtacaggctggccccggagcataaatttccggcagcagtagatgatgcctattctgcgtataaatgggcgaggaagaacgcacgcgagatcggcataaaggaaggcctcatagcagtgggaggggatagcgctggcggaaaccttgcggctgttgttacgttaaaggcgaaggatgagaaatacgatcagccaatgctccaggtccttttctatccagcccttggtccagacttcttcagcgaatccctgagggaatatggcgaagggtatttccttacaaagaagcagatggacaacttcggggcaatgtatttcaggaacccggctgatgccttcagtccctacttcgcgcctatcctttacggaaacttttccggcgttgcggaggccataattgtaacggcagagcacgatccccttagggatcagggggagatgtacataaaagagctctatgactccggcgtccaggtcacaggaataagggcaaagggcatgatacatggtttcctgagcttttcggccattgtcccggccgcggacaacctattcacaatggtatgggcgatggtaggttcaaaactcaggaaataa

SEQ ID NO: 816 - protein, 282 aa, Unknown
  Obtained from environmental sample
MQDLRRIMKEYRFPETPEEVESTKDYYLEQNGERIRMRLYTPIGGSDSLIVYYHGGGFVFGDIKLYDNVCRKIATRSSSKVLSVKYRLAPEHKFPAAVDDAYSAYKWARKNAREIGIKEGLIAVGGDSAGGNLAAVVTLKAKDEKYDQPMLQVLFYPALGPDFFSESLREYGEGYFLTKKQMDNFGAMYFRNPADAFSPYFAPILYGNFSGVAEAIIVTAEHDPLRDQGEMYIKELYDSGVQVTGIRAKGMIHGFLSFSAIVPAADNLFTMVWAMVGSKLRK

SEQ ID NO: 817 - DNA, 1632 bp, Unknown
  Obtained from environmental sample
atgaaccaaaatgcaccttatcatcccatcatttacgtgcgcggtttcgccgccacgcagggtgaaatcgaagaaacctgcgccgatccctacatgggattcaacctcggctcaaccaaggcccgccaagtctggactggcgaattgaagaagtttttcttcgagtcgccgctggtgcgccttcatacggaccacgactaccgggacgtctattttgagggcgaagacctcgtcgcctcggatcgctcagacatcccgctgccgtacaagtcagtcgtgatctatcgctattacgacgaggcctcggaagccttcagcaacggaaatactccgccgatccagcacttcggcatcggactcggaaagttgatcctgcagttgcgcgacaagatttgcagcaatgccgagaacggcgttgcacccgaagatttccgcgtctatctggtggcccattccatgggtggtctggtgtgccgctgctttctgcaaaacctgcagctcggcaccgatccaaagttcgccctgagtccggcggaactggcaaatttgagtgaagcacggaaactcgtggacaagtttttcacctacgcgactccgcataatggcattgacctgcgcatcgttcgtaacgttcccgcttgggccagcttcggtgacgtgaacaacttcaaccgcgatcgcatggctgattacctcggcctgcctgtcggcaacgatgacgtctcggatttgggccccttccccgctgaacgcgtcttcaacctcgtcggcaccaacccaaatgattacgcggtgatgcggggggtttccgcctgggcagccggggacgccagcgacggtctggtccgcatcgagaacgcaaccacccacggacgcgacgcgcaaggcaacgacatctcctccccgcgtgcctacgtcaaccgaagtcattccgggcattacggaatcgtcaactccgaggaaggttaccagaacatgacccgtttcttcttcggcaacttccgcatcgatggcgtgttggacattgatgagttgcttctgcccaaagaggtcaacgacaagctgacggaaatgtcagctgcagaccgggacaagttcaaggcgtcatatcagttcgaagtggcggtcagcattcgcaactgtcagtggcagatgcaccggcgcaacgtccgagaaaactccgccattttcagaacttacgaccagctctttccccgcgacgctcaagggatccgccaaccggatcgccaacaaagcccccatttgttctctgcatttctcgaccaagccagaagcatcaagcgcacaaaatccgtgagcctggcgtttgacgtctcggtgctcgtcccggattacaccattgacggagtgctgttcttcaaacgtcactacgaaggcggttacatttacaaggagcagatcatcgtcgaagcaacccctgatgaagaggcgttgggcggctggcgcattaattatggctaccagaacgacactcccaacctggcgcgcaaactggccgaaacccgcgcactgccaaacaagcaaggccttgccttcgatattgaaatcatcaaggacacccggcccggcatcaaagccagactccgggtcgaagccagagaatgggcttaa

SEQ ID NO: 818 - protein, 543 aa, Unknown
  Obtained from environmental sample
MNQNAPYHPIIYVRGFAATQGEIEETCADPYMGFNLGSTKARQVWTGELKKFFFESPLVRLHTDHDYRDVYFEGEDLVASDRSDIPLPYKSVVIYRYYDEASEAFSNGNTPPIQHFGIGLGKLILQLRDKICSNAENGVAPEDFRVYLVAHSMGGLVCRCFLQNLQLGTDPKFALSPAELANLSEARKLVDKFFTYATPHNGIDLRIVRNVPAWASFGDVNNFNRDRMADYLGLPVGNDDVSDLGPFPAERVFNLVGTNPNDYAVMRGVSAWAAGDASDGLVRIENATTHGRDAQGNDISSPRAYVNRSHSGHYGIVNSEEGYQNMTRFFFGNFRIDGVLDIDELLLPKEVNDKLTEMSAADRDKFKASYQFEVAVSIRNCQWQMHRRNVRENSAIFRTYDQLFPRDAQGIRQPDRQQSPHLFSAFLDQARSIKRTKSVSLAFDVSVLVPDYTIDGVLFFKRHYEGGYIYKEQIIVEATPDEEALGGWRINYGYQNDTPNLARKLAETRALPNKQGLAFDIEIIKDTRPGIKARLRVEAREWA

SEQ ID NO: 819 - DNA, 849 bp, Unknown
  Obtained from environmental sample
atgacggccgagatcctgaaaaccaaagtcagttttgagacggtcgagttcgaccgcttcaccgcctgctttgccgaatccaacaattgcgtggagccctgcgaccgcgtgattctctatctgcacggcggcggctataccgcgggcgggctggactacgcaaagggctttggcgcgctgctcgcggcgcagacgcacgtgaccgtgctctgcatcgcctatcgcctcgccccggagcacaaattccccgccgcgcaggacgacgcgatggacgcgtatcaatacctgctcgactccggctatgcgccggacaagatcgccgtcgcgggcgaaagcgcgggcggcggcctcgcgctgagcctcgtactgcgtctgcgggacgaggggaaaccgcttccctcctgcatcgtcgcgatttcgccgtgggcggacctgacgctctccggctcttcctacaacaacaacgtccgcctcgacccgacgctgatccgcgaatcgcttgcgtattatgtgatcgcctacgccgcggggcacgaggacgaggcgtacgtttcccccgtactgggtgactttaccaagtttccgccgacactgctctttgccggcagcgacgaaatcctgctttcggacgcgaagaccgtctacaagcgcctgaaaaaagcaggtgtggagagcaagctcgtcgtggaagagggcatgtggcacgtctacccgctctatggcacgccggaaggcaagaaggcgctttcagagatggcgctcttcctccgctcccgattgggattggaagagctctccgccgcgcaaaagcaggagcttcccgcgcaaacgcgcacaaatcccgcgtaa

SEQ ID NO: 820 - protein, 282 aa, Unknown
  Obtained from environmental sample
MTAEILKTKVSFETVEFDRFTACFAESNNCVEPCDRVILYLHGGGYTAGGLDYAKGFGALLAAQTHVTVLCIAYRLAPEHKFPAAQDDAMDAYQYLLDSGYAPDKIAVAGESAGGGLALSLVLRLRDEGKPLPSCIVAISPWADLTLSGSSYNNNVRLDPTLIRESLAYYVIAYAAGHEDEAYVSPVLGDFTKFPPTLLFAGSDEILLSDAKTVYKRLKKAGVESKLVVEEGMWHVYPLYGTPEGKKALSEMALFLRSRLGLEELSAAQKQELPAQTRTNPA

SEQ ID NO: 821 - DNA, 726 bp, Unknown
  Obtained from environmental sample
atgatcggggagcggctggtgcaggaggtggtgccgggggtgcaccgcatcaacctgggtgtggtgaacgcgtacgtgctgcaggcggaggacgggatcacgctcgtcgatacggggatggggaccacgcggccgctgctgctgcgcgggctcgcggcgctgggcatcgacgtccgcgacatccgccgcatcctggtgacgcacgcgcacccggaccacaccggcgcgctggcatccctgaagcgcgcctcgggagcccgggtctacatgcacccggacgacgcggcgctggtccggcaggggcgctcgctgcggcccgggctccgcccgccgccgcgccacctctacacgttcacggtgccgctggtggcgtgggccatccctgggcacgtggaggcggtggagaccgatcagccggtgcgcgacggcgaccatctggaagtcgcgggcgggatgcgcgtcgccgggtttcccgggcactccgcggggcaggtgggctatctgtggcagcggcacgggggcgtgctgttcgccggcgacacggccgccaaccagctggggcggctggacgtggcgatcgtgtacgaggactacgcgcaggggatgcgcgacctggtgaagctcgcatcgctggagtacgacaccgtctgctttggccacggcccgccgatcatcggcggcgcctccgccgcggtgcgccgcaagtggggcccggcgggcgcgtga

SEQ ID NO: 822 - protein, 241 aa, Unknown
  Obtained from environmental sample
  DOMAIN (21)...(220): Metallo-beta-lactamase superfamily
MIGERLVQEVVPGVHRINLGVVNAYVLQAEDGITLVDTGMGTTRPLLLRGLAALGIDVRDIRRILVTHAHPDHTGALASLKRASGARVYMHPDDAALVRQGRSLRPGLRPPPRHLYTFTVPLVAWAIPGHVEAVETDQPVRDGDHLEVAGGMRVAGFPGHSAGQVGYLWQRHGGVLFAGDTAANQLGRLDVAIVYEDYAQGMRDLVKLASLEYDTVCFGHGPPIIGGASAAVRRKWGPAGA

SEQ ID NO: 823 - DNA, 426 bp, Bacteria
atggaatttgaaatcaatggtattcaataccgtacagccaaattgagtgtgttcgatcagctgaaggtgtcacgtaagttgttacccgttcttgccggattagtctctgatattcgcgccgtacagacgatggcccaagacaaaaatatggaaggggcattagagaaggcgctgcctaaaattgcgcaggcggttagcgacttaagcgacgaagattgcaacgcgatcctttacccctgcctgtctgttgtatcacgacaacacggcaagggatggacgcccgtattctcgcagggagtcttgcatttcgatgacatagacttgccaacattgttgcaattagtcgcgagggtgatcggggattcattgggaaattttttgcacgcactccccgccgcagagacgcccttcccgccagcggcctag

SEQ ID NO: 824 - protein, 141 aa, Bacteria
MEFEINGIQYRTAKLSVFDQLKVSRKLLPVLAGLVSDIRAVQTMAQDKNMEGALEKALPKIAQAVSDLSDEDCNAILYPCLSVVSRQHGKGWTPVFSQGVLHFDDIDLPTLLQLVARVIGDSLGNFLHALPAAETPFPPAA

SEQ ID NO: 825 - DNA, 1038 bp, Unknown
  Obtained from environmental sample
atgacaacacaatttagaaacttgatatttgaaggcggcggtgtaaaaggtgttgcttacattggcgccatgcagattctcgaaaatcgtggcgtgttgcaagatattcgccgagtcggagggtgcagtgcgggtgcgatcaacgcgctgatttttgcgctgggttacacggtccgtgagcaaaaagagatcttacaagccacggattttaaccagtttatggataactcttggggtgttattcgtgatattcgcaggcttgctcgagactttggctggcacaagggtgacttctttaatagctggataggtgatttgattcatcgtcgtttggggaatcgccgagcgacgttcaaagatctgcaaaaggccaagcttcctgatctttatgtcatcggtactaatctgtctacggggtatgcagaggttttttcagccgaaagacaccccgatatggagctagcgacagcggtgcgtatctccatgtcgataccgctgttctttgcggccgtgcgccacggtgaccgacaagatgtgtatgtcgatgggggtgttcaacttaactatccgattaaactttttgatcgggagcgttacattgatctggccaaagatcccggtgccgttcggcgaacgggctattacaacaaagaaaacgctcgctttcagcttgagcggccgggctatagcccctatgtttacaatcgccagaccttgggtttgcgactagatagtcgagaggagatagggctctttcgttatgacgaacctctcaagggcaaacccattaagtccttcactgactacgctcgacaacttttcggtgcgttgatgaatgcacaggaaaagattcatctacatggcgatgattggcagcgcacggtctatatcgatacattggatgtgggtacgacggacttcaatctttctgatgcaactaagcaagcactgattgaacagggaattaacggcaccgaaaattatttcgagtggtttgataatccgttggagaagcctgttaatagagtggagtcatag

SEQ ID NO: 826 - protein, 345 aa, Unknown
  Obtained from environmental sample
  DOMAIN (8)...(195): Patatin-like phospholipase
MTTQFRNLIFEGGGVKGVAYIGAMQILENRGVLQDIRRVGGCSAGAINALIFALGYTVREQKEILQATDFNQFMDNSWGVIRDIRRLARDFGWHKGDFFNSWIGDLIHRRLGNRRATFKDLQKAKLPDLYVIGTNLSTGYAEVFSAERHPDMELATAVRISMSIPLFFAAVRHGDRQDVYVDGGVQLNYPIKLFDRERYIDLAKDPGAVRRTGYYNKENARFQLERPGYSPYVYNRQTLGLRLDSREEIGLFRYDEPLKGKPIKSFTDYARQLFGALMNAQEKIHLHGDDWQRTVYIDTLDVGTTDFNLSDATKQALIEQGINGTENYFEWFDNPLEKPVNRVES

SEQ ID NO: 827 - DNA, 879 bp, Unknown
  Obtained from environmental sample
atgtctaaatcattacaatatcccattattctcgttcacggtttcagtggttttgataaagttgctggagtctatccttactttttcggtattcagccagcactggaaaaagccggagcaacggtattcgccgcctctctatcggcagaaaacagcaatgaagctcgtggtaagcaattgctcaattttgtaaaacaagtcacccagttaaccggagcagccaaggtcaacctgattggccacagccagggcccgttagcctgtcgctacgtcgccgccattcatcccgaactggttgcgtctgttacctccgtgaatggggcaaattttggctcggaaattgccgatctagtccgtttggcggtgaaaccaggctcccttccagaagctattgcaggcgcagtgatgaacgcttttggttcattcctttcccttatgactggccgcccttccctgccacaagacagtgtcgcagcgcttaactcgctcaccagcgaaggcgtcgctaaattcaatgccaaatatccgcagggtttaccaagcaattggggaggagaaggtaaagagtttgagaatggtgtttattattattcttggggtggggtaattaattacaacccgattgagcaagggctcaataattttgatccattgcatacctccatggttgccctctcatttctgttcacaaaagaacgtttccaaaatgatgggttggttgggcgttatagtatgcatctcggcaaagtgatccgctccgattactcaatggatcacctggatgctatcaatcaaactgcgggggttgttaccagcagtaccaaccccgttcaactctttgttgatcacgtggcacgtttaaaatcgaaagggttataa

SEQ ID NO: 828 - protein, 292 aa, Unknown
  Obtained from environmental sample
  DOMAIN (18)...(272): alpha/beta hydrolase fold
MSKSLQYPIILVHGFSGFDKVAGVYPYFFGIQPALEKAGATVFAASLSAENSNEARGKQLLNFVKQVTQLTGAAKVNLIGHSQGPLACRYVAAIHPELVASVTSVNGANFGSEIADLVRLAVKPGSLPEAIAGAVMNAFGSFLSLMTGRPSLPQDSVAALNSLTSEGVAKFNAKYPQGLPSNWGGEGKEFENGVYYYSWGGVINYNPIEQGLNNFDPLHTSMVALSFLFTKERFQNDGLVGRYSMHLGKVIRSDYSMDHLDAINQTAGVVTSSTNPVQLFVDHVARLKSKGL

SEQ ID NO: 829 - DNA, 735 bp, Unknown
  Obtained from environmental sample
atggcactgttcgttctcgtccacggagcttggggcacgcccaccgagctcgccccggtcgaaccggcgctcacggcggcggggcacgaggtccgaatcgtcgacctgccctgcaccgaccccgacgccaccttccacgactacgccgaggcggtgatcgcccagttgggcccgcccgagcgcgaccccgagaccctgctcgtcgggcactcgttcggcggcgcgaccatcggtctggtccgcgaacgccggcccgacgtggcgctggtgtacgtcacggcagtggtgctcgaacccggccagtcgctgctcgagttgttcttcggctccgatccgttcgacgaccccgacgtggacgacccgtgggagggcttcgaagggctggtgctcgacgccgggccgggcctcacccgggtcgacctcgacgtgttggccgccggggtacccgaggaccagcgcgccgagttgctcgctgccctcgaaggcacccagcgcgagcagggcatcgcggtcatgcgggagggctggccgggcgcgtcggtgccgagcggttgggtcagctacatcgtggcgaccgccgacacgctgctcgagcccgacctgcagcgcccgatggccgacatgctcggggccgacgtgtacgaggtgcactccgaccacgaggtgttcatcgagcagcccgaagagttggcgaagatcctcgacgacctcgccgccggcctcaccagccgatga

SEQ ID NO: 830 - protein, 244 aa, Unknown
  Obtained from environmental sample
MALFVLVHGAWGTPTELAPVEPALTAAGHEVRIVDLPCTDPDATFHDYAEAVIAQLGPPERDPETLLVGHSFGGATIGLVRERRPDVALVYVTAVVLEPGQSLLELFFGSDPFDDPDVDDPWEGFEGLVLDAGPGLTRVDLDVLAAGVPEDQRAELLAALEGTQREQGIAVMREGWPGASVPSGWVSYIVATADTLLEPDLQRPMADMLGADVYEVHSDHEVFIEQPEELAKILDDLAAGLTSR

SEQ ID NO: 831 - DNA, 2430 bp, Unknown
  Obtained from environmental sample
atgcgaaagggtatcgtggcatgcatcgccgcagtgatgatccaggtcctggcggccttcggggcgctcgcggcctcccgggtttatctccccgaagccgctttcgtccgggagcagctcgcgacgcgcgaagcggtccccgcggcggagctcggctcggtcctgggattttccagtcgggaggggctgcgcctcctcgccgagaacacggacgaaaacgacgtcacccactcccgctacgtgcagctcttcgacggggtccccgtctggggctaccacatcatcgccgccaccgatgaggacgattccctcgtgagcctccacggcacgcgggtggccgacatcgaggcggacatcgccccggagctactcgccgcgcggccgctcaagacggagcgtgaaatgctcgccgcgatgaagcggcgccatgccgccaagagcctggccggcggcgggcggctgatcttcgaaaacgaggtgagcgagaaggtgatctacgtgggcgaggacggccgggcgcgcctgtgcttccacgtctccttcttcgccgacgcggccgagggcggaagcccctcgcggccggtgatcctggtggacgccgtgaccgaggagatcgtgctcgagttcgaggggctgacccacgccgagggcaccggcccgggcggaaacgtgaagatcggaaaataccgctacgggaccgactatccgcccttcgaggtgaccccgtccggcggcaactgcgtcatgaacaacgccaacgtgaagacggtcaacctgaaccacgggaccagcggctcgaccgcctaccagtacgcctgctacgagaacaccttcaaggagatcaacggcggctactcgccgctgaacgacgcccacgccttcggcgccgtcgtcttcgacctgtacaagcagtggttcaacaccgcgcccctcaccttccagctcatgatgcgcgtccactacagcacgggctacgacaacgccttctggaacggctcgtcgatgaccttcggcgacggcaagacctatttctatcccctggtctcgctcgacgtcgtcgcccacgaggtgagccacggcttcaccgagcagaactccaagctcatctactccaaccagtccggcggcatcaacgaggccttctccgacatggcgggcgaggccgcggagttcttccaccggggcaaaaacgacttcatggtgggctatgacatctggaagctcagcgccaccggcgcgctgcgctacatggacaacccgccgaaggacggcaaatcgatcggcagcgccaaggattacacggccggcatggacgtccactactcgagcggggtcttcaacaaggccttctgggcgctcgcgaccaccccgggctgggacaccaagaaggccttcgccgtcttcgtcaaggcgaaccagaactactggcagcccagcaccaacttccagcagggcgccgagggggcgcgcgacgcggccatcgcgctcggcttctccgcccaggcggtgaaaaacgccttcgccaaggtcgacatcacgatcgacgccccgccggacatcccgccgctcgttgagatcctgagcgtctcgaccggcaaaacgtacgcgctcggcgcggcgcaggtcggctccaggccgtacatcgaccgcacctacacgatcaaaaagatcggcgccgggcttgccggcggggtgctcgtccagaccgccaacgacgacaagaaggtcgccgtcgcaagccacctcaagctcaaggccctcaaggacatcgtcctctacgccgcctacgacaagcgcggccaggcgaagccgcccacctggctcgccgcctggcagccgaccatcgaggcgctggagaccaccgacgccgacgcctcgccgatgaaggtcttcaagaagagcttcgccgccggcgccgagatcaccctgggcggcaacctccagggcggggacaacggcgcgcagagcaactacttcctcgtcgcgcggccgctcgagacgacgctcgtcgacatcctctcggtctccaccggcaaggcctacgcgctcaccgccgccaaggccggcgccaaggcctacatcgaccgcgactacaccgtgaccgccctctccgcggggcttgccggcgggctgctcgtccagaccgccaacgacgacaagaaggtcgccgcggcgagccacctcgtgctcaaggccaaccgggcggcggcgatctatgtcgcctacgaccggcgcgcgaccaagctgccggactggcttgccgccggctggacggcgaccgccgagtcgctcgggacgaccgacagcggcgcttcgccgctcaaggtctacaagaggaccgtcgccgccggcgcccagatcaccctgggcgggaacatggccgccggcgccgccggcgccgaaagccactacctcgtcgtcgtcaaatag

SEQ ID NO: 832 - protein, 809 aa, Unknown
  Obtained from environmental sample
  SIGNAL (1)...(24)
  DOMAIN (221)...(364): Thermolysin metallopeptidase, catalytic domain
  DOMAIN (366)...(512): Thermolysin metallopeptidase, alpha-helical domain
  DOMAIN (37)...(210): Thermolysin metallopeptidase, propeptide
MRKGIVACIAAVMIQVLAAFGALAASRVYLPEAAFVREQLATREAVPAAELGSVLGFSSREGLRLLAENTDENDVTHSRYVQLFDGVPVWGYHIIAATDEDDSLVSLHGTRVADIEADIAPELLAARPLKTEREMLAAMKRRHAAKSLAGGGRLIFENEVSEKVIYVGEDGRARLCFHVSFFADAAEGGSPSRPVILVDAVTEEIVLEFEGLTHAEGTGPGGNVKIGKYRYGTDYPPFEVTPSGGNCVMNNANVKTVNLNHGTSGSTAYQYACYENTFKEINGGYSPLNDAHAFGAVVFDLYKQWFNTAPLTFQLMMRVHYSTGYDNAFWNGSSMTFGDGKTYFYPLVSLDVVAHEVSHGFTEQNSKLIYSNQSGGINEAFSDMAGEAAEFFHRGKNDFMVGYDIWKLSATGALRYMDNPPKDGKSIGSAKDYTAGMDVHYSSGVFNKAFWALATTPGWDTKKAFAVFVKANQNYWQPSTNFQQGAEGARDAAIALGFSAQAVKNAFAKVDITIDAPPDIPPLVEILSVSTGKTYALGAAQVGSRPYIDRTYTIKKIGAGLAGGVLVQTANDDKKVAVASHLKLKALKDIVLYAAYDKRGQAKPPTWLAAWQPTIEALETTDADASPMKVFKKSFAAGAEITLGGNLQGGDNGAQSNYFLVARPLETTLVDILSVSTGKAYALTAAKAGAKAYIDRDYTVTALSAGLAGGLLVQTANDDKKVAAASHLVLKANRAAAIYVAYDRRATKLPDWLAAGWTATAESLGTTDSGASPLKVYKRTVAAGAQITLGGNMAAGAAGAESHYLVVVK

SEQ ID NO: 833 - DNA, 1140 bp, Unknown
  Obtained from environmental sample
atgctcgccatgcagcgggagaccagcgtctcgatgtcgcagcgcacgacgcgggccgtcggcgtcgcagcggccctcgccctcctcgtgggcttcccgtctgccgcgcagcagcctggcgccgggccgagcgtgatcgatctcatgatccagtcgcgcagccaggagcagccgcagccgagcgcccggcacatctccctgccggccggtaatccgctcgaggtgctgcacgtccacggccagatctacatgattgccggcggcccggccaacgtggccgtgcagatcggaccggagggcgtgctgctggtcgacacggcgaccgaggatctgagcgagcacctgctgcaggccgtgcgcgtcctgtccgacggtccgatcagttacatcgtcaacacgacccccgatcggagtcattacggcggcaacgcggtcctcagcgccgccggacggaatccgacgacggccgagcgcgacctgacaggccacgtcgccggcctcgccgcaggcgaccgccgcgacgacacgccgggcggcggacccggggcggcgatgcgcccgaccggtgcgatcgttttcggacacgagaacgtgctcctccgcatgagcgccgccaccgagccgttcgcgctgtggccgaccagcaccttcttcacgcgcctgaagaccttctcgttcaacgacgagccgatcgaattgctgcatcagccggcggcgcacacggacggcgacctcatggtgtttttccgcaggtccgacgtcctggccgtgggtccgctgatcgacacgctgcagtatcccgtcttcgacgccgcgcgcggcgggagcatgcgaggcatcctcgacggcctgaacgagatcatccgcatcaccgtgccgcgcttcaaccagatggccgggacccgcgtcgtccccgggcgcggccgcatcctgaacgaagccgacgtcgtcgagtaccgcgacatgatgacgatcgtctacgagcgggtccgcgacgcagcgaaggacggcacgtcgctcgccgagatcacgaggatgcagccgacgctcgagtacgacccgctgtactccgtccccggatggaccggcgagatgctcatcgaggccatctatgaggaggtgcgccggcagggggcgtag

SEQ ID NO: 834 - protein, 379 aa, Unknown
  Obtained from environmental sample
  SIGNAL (1)...(36)
MLAMQRETSVSMSQRTTRAVGVAAALALLVGFPSAAQQPGAGPSVIDLMIQSRSQEQPQPSARHISLPAGNPLEVLHVHGQIYMIAGGPANVAVQIGPEGVLLVDTATEDLSEHLLQAVRVLSDGPISYIVNTTPDRSHYGGNAVLSAAGRNPTTAERDLTGHVAGLAAGDRRDDTPGGGPGAAMRPTGAIVFGHENVLLRMSAATEPFALWPTSTFFTRLKTFSFNDEPIELLHQPAAHTDGDLMVFFRRSDVLAVGPLIDTLQYPVFDAARGGSMRGILDGLNEIIRITVPRFNQMAGTRVVPGRGRILNEADVVEYRDMMTIVYERVRDAAKDGTSLAEITRMQPTLEYDPLYSVPGWTGEMLIEAIYEEVRRQGA

SEQ ID NO: 835 - DNA, 1263 bp, Unknown
  Obtained from environmental sample
atgcgttggatgatgaaatccgcgattggaatcgtagtcagtctcatgttagtcagctcgggcctcgttgcagaaacgccgagggcgaagccggaagacgtcgggatttcctccgagcgcctgcgccggatacacgatctgatgcagaggcacatcgatgccggaagcttttcagggtccgtcactcttgtcgctcgcaacggacggatcgcgcacctcgaggcgcaaggcttgatggacatcgaaacacggaagccgacggcgccggatgcgattttccgcattatgtcgatgaccaaacctgtggtgggcgttgcgatcatgtcgctggtcgaggagggcaaagttcggctcaacgatccggtttcccgattcttacctcaattcaaagatctgagagtcgccgtcgtccagcccgccgccgcaggcgggcaacgaggaggtggaacaccggcggaagtccggttctacaccgttcctgtcgagcgcgaaatcacgatcaaagatcttctcacgcatacctccggcatggtgagtgggaccatcagcagtcaggaaagccgaaaagtcgccttgagggagaacgagtcgaatgccgatttcgtcccgcgtctggcgacagttccgctggaattccaaccgggatcgcggtgggcctatagcgcgacggcggcctgggacaccatggttctgatcgtcgaggtggcttcgggacagaagttcgaccagttcgcgcagcagcggatcttcgggcctttgggaatgaaagacacgttcttctatccggccgaatcgcacaactcccgcatcgcgacgctgtactcgcgaaccgagaagggcctgcaacaggccgcaaacccgaatttcatgaacggcgtctacttttccggcggcggcggcctctacagcacggccgaggattacgtgcaattcggcatgatgcttgtcaacggcggcgagtggaatggaaagcgagtgctcagcccgcgttcggtcgagatgatgcggtccgtctttatcccggacacgctgccgggccgtcctcgcggcgaaggtttcgggctgagcgtgcgcgtcgtgaacgacccgctgcaacgcggcacggcgctttcggccggaagtttcggctggagcggcgccttcggtacgcatttctgggtggatccgaaagaaaaagtcgtcgcgattctgatgacgcagacgtcgactccgggactgaacctcgatttcgagaacgccgtgatgcaagcgatcgtgcagtag

SEQ ID NO: 836 - protein, 420 aa, Unknown
  Obtained from environmental sample
  SIGNAL (1)...(24)
  DOMAIN (44)...(420): Beta-lactamase
MRWMMKSAIGIVVSLMLVSSGLVAETPRAKPEDVGISSERLRRIHDLMQRHIDAGSFSGSVTLVARNGRIAHLEAQGLMDIETRKPTAPDAIFRIMSMTKPVVGVAIMSLVEEGKVRLNDPVSRFLPQFKDLRVAVVQPAAAGGQRGGGTPAEVRFYTVPVEREITIKDLLTHTSGMVSGTISSQESRKVALRENESNADFVPRLATVPLEFQPGSRWAYSATAAWDTMVLIVEVASGQKFDQFAQQRIFGPLGMKDTFFYPAESHNSRIATLYSRTEKGLQQAANPNFMNGVYFSGGGGLYSTAEDYVQFGMMLVNGGEWNGKRVLSPRSVEMMRSVFIPDTLPGRPRGEGFGLSVRVVNDPLQRGTALSAGSFGWSGAFGTHFWVDPKEKVVAILMTQTSTPGLNLDFENAVMQAIVQ

SEQ ID NO: 837 - DNA, 207 bp, Unknown
  Obtained from environmental sample
atgccccggggctctctcgtcccgctcgtcaccccgttccgcaacggtgagatcgatcgctccgccttcgcggacctcgtcgagtggcagatcgacagcggcacgcacggtctggtcattggcgggacgaccggcgaacccgcggccttgacgctggaggagcgggagttcctgatccaggaggcggtccgcctggcgcgtgggcgg

SEQ ID NO: 838 - protein, 69 aa, Unknown
  Obtained from environmental sample
MPRGSLVPLVTPFRNGEIDRSAFADLVEWQIDSGTHGLVIGGTTGEPAALTLEEREFLIQEAVRLARGR

SEQ ID NO: 839 - DNA, 1074 bp, Unknown
  Obtained from environmental sample
atgagagtagaagagatggtactgaatggggaaagaaatgtaacattaacagcttatatccaggaagttgccggagagtttcgcaatattgaaaagcggccggcaatattgatccttccggggggagggtaccagttttgctcggacagagaggctgatccggtggcaatgccctttttaaaagccggatttcaggtttttatcttaaggtattcagtgaaagaagatgccgtctggcccaatccgctggatgattatgaacaggctatggaattgatacgctccaaagaggaggagtggaaattgtatgccgataaggtggcggttattggattttccgcaggcgggcatttggcgggctgtgcggctgcgatgtcaaagaatcgccccaatgctgcagttttgggatatgctgtgctgggagaggatgtcaaaggctgcaatgtgagtgctccggatgtgattgcgtcagtggatgccgatacctgcccctgcttcgtatttgcgacgcgtacggataatgtagttccgattgaaaactccaccagatttctgacggctttggccgatgcaggcatcgcatttgaaagtcatatttatagttatgggcctcatggattttcaacatgcgattcatctgtacaggcgctggatggaattacaaaaagagcgcccgggtgggttaatgatagtattggctggctaaaagaaatccttggagattttggtgagaacggccttgaagcgccgaagtgcccagcgagagtgaacgatgataacatgccttatttatcagtggactgcagctttaagcgtttgcagcaggttcccgccgcaaagcagatattggatgggattttccaaaacatgcggagcagtgcggctgaacagtatgcagataatcctatgatggatcttatgagcgagaatacagaaggcggcggtctgttttcaatagtaagaaatatgactttaagagatatattaagctttggacgggtgacagatgacattgtggccgcaattaatagtcaacttgagaagatacctaatgtaagtaaagcatcaaattga

SEQ ID NO: 840 - protein, 357 aa, Unknown
  Obtained from environmental sample
MRVEEMVLNGERNVTLTAYIQEVAGEFRNIEKRPAILILPGGGYQFCSDREADPVAMPFLKAGFQVFILRYSVKEDAVWPNPLDDYEQAMELIRSKEEEWKLYADKVAVIGFSAGGHLAGCAAAMSKNRPNAAVLGYAVLGEDVKGCNVSAPDVIASVDADTCPCFVFATRTDNVVPIENSTRFLTALADAGIAFESHIYSYGPHGFSTCDSSVQALDGITKRAPGWVNDSIGWLKEILGDFGENGLEAPKCPARVNDDNMPYLSVDCSFKRLQQVPAAKQILDGIFQNMRSSAAEQYADNPMMDLMSENTEGGGLFSIVRNMTLRDILSFGRVTDDIVAAINSQLEKIPNVSKASN

SEQ ID NO: 841 - DNA, 1689 bp, Unknown
  Obtained from environmental sample
atgggattgttcgattacaaaaatgccgacggcaaagcgctgtacagcgacgccatcgccctgacgctgtatgcctacacgccgaccgggcaggcattgcccggcaccggctggaagccgatcggcgccacggcgctgggctatcagggcaaggtcggggcgcagggcacgtttttcggcgagaaggacggcttcaccagcgccgaagccgaagtgctcggcaagtacgacgccgcgggcaaactgatcggcatcggcgtggcttttcggggcaccggcgggctgggttacagcgacaccttcggcgacatgaaaaacaatctgctggccgccatcggcccgacggattacgccacccagtacgcgaaaaacgccttcgacaacctgctcaagtcggtagccgctttcgctgtcgcccacggcatcgcggccaaggacgtgctggtcagcggccacagcctcggcggtctcggggtcaacagcgtggcggagttgagcgcgagcaactggggcgggttcttcaaggacgccaactacatttcgttcgcctcgccgacccagagcagcaccggcaccaacgtgctgaacatcggttacgagaacgacccggtgttccgcgtactcgacggcaccacgttcagtaccgcgtcgatgggcaagcatgacaagccgcacgattcgaccaccgacaacatcgtcaacttcaacgacaactacgcgtccaccgcgcagaacctggtgccgttcagcatcgccaatccgctgaactggtcggcccacagctcgctggggtatgccgacggcctgaaccgggtgatcgcgtcgaagttctacggcctgacccacaaggattcgacgatcatcgtctccaaccttgagcaagcgtcgcggggcaagacctgggtcgaggatctgggccgcagcggcgagccgcacaccggcagcaccttcatcatcggcaccgacagcggtgactggctcaagggcggggcgggcaacgacttcctcgaaggcctgggcggcgatgaccgtttccgtgacgacggcggtttcaacatcctgctcggtggccagggccacaacaccttcgagctgcaaaagccgttgcagaacttcagcttcgccaacgatggcgacggcacgctgtacgtgcgtgacgcctatggcggcatcagcatgacccgtgacatcggcgcgctggtgagcaaggagtcaggctcgtggtggggcagcaaggaaatcacctggaccgtcaccgccaaaggcctggccaacggtgccgaactgacccagtacaaccattcgctcagcggcggcgccatgggcgacaccctgaaagccaccgctgacggcgactggctgttcggcctgggcggcaacgatcacctgcaaagcgacaaggcccacgtgacctttgtcggcggcgccggtaacgacgtgatgagcgcggtgggtggcaacaacactttcctgttcagcggggcgttcggcttcgacgcgatcaatggctaccagggcagcgacaaactggtgttcatgggcgtcgaaggcgcagggcagggctacgactacaagcaacacgcgtcgcagtccggaagcgataccgtgctgaagattggcgactttgccgtgacgctggtcggggtcggtgtggctaacctgtcggattcgagtttcgtcttcgcctga

SEQ ID NO: 842 - protein, 562 aa, Unknown
  Obtained from environmental sample
  DOMAIN (82)...(212): Lipase (class 3)
MGLFDYKNADGKALYSDAIALTLYAYTPTGQALPGTGWKPIGATALGYQGKVGAQGTFFGEKDGFTSAEAEVLGKYDAAGKLIGIGVAFRGTGGLGYSDTFGDMKNNLLAAIGPTDYATQYAKNAFDNLLKSVAAFAVAHGIAAKDVLVSGHSLGGLGVNSVAELSASNWGGFFKDANYISFASPTQSSTGTNVLNIGYENDPVFRVLDGTTFSTASMGKHDKPHDSTTDNIVNFNDNYASTAQNLVPFSIANPLNWSAHSSLGYADGLNRVIASKFYGLTHKDSTIIVSNLEQASRGKTWVEDLGRSGEPHTGSTFIIGTDSGDWLKGGAGNDFLEGLGGDDRFRDDGGFNILLGGQGHNTFELQKPLQNFSFANDGDGTLYVRDAYGGISMTRDIGALVSKESGSWWGSKEITWTVTAKGLANGAELTQYNHSLSGGAMGDTLKATADGDWLFGLGGNDHLQSDKAHVTFVGGAGNDVMSAVGGNNTFLFSGAFGFDAINGYQGSDKLVFMGVEGAGQGYDYKQHASQSGSDTVLKIGDFAVTLVGVGVANLSDSSFVFA

SEQ ID NO: 843 - DNA, 1032 bp, Unknown
  Obtained from environmental sample
atgcgcctgaacgtttttttgcgccccttggtctgtttgagtctgcttggccttgccgcctgcggcagcaatccccccagccccgcagcgacacccgagccgcccaccgcaaccacatcagcccccccgatcaagatcggcctggcgctgggcggcggtgcggccaagggctttgcccatatcggcgtcatcaagatgctcgaggccaatggcctcacgccctcgttcgtggccggcaccagcgccggcagcgtggtgggtgcgctctatgcaagcggcatgaacgccttcgagctgcaggaaaaagccgtggcgctggacgaagccaagatccgcgacctgcagctgtccgctggcggtctggtactggggcagaagcttgaggactatgtgaatgaacaagtccaccgcaagccgctggagcagatgaccaagccctttgtcgccatctccacgcgcctggaagacggtgaacgcacggtgtttgcacgtggcaatgtgggccaggccgtgcgcgcctccagcagcgtgccgggcgtgttccagcccgtcaccatcggcaagtaccactatgtggacggcggcattgtcagccccgtgccggtcgatgccgtgcgcaatctgggggccgacatcgtgattgccgtggacatctccaacaaggccagcggcaagaccccggccaatatgctgggcgcgctcaatcagtcgattgccatcatgggccagaagctgggtcaggccgagctggcgcgagccgacatcatcattcgtcccaaggtgctggacatcggcccggccgacttcgcgcagcgcagccatgcgattgtggaaggcgagaaggccgccactgcactgatgccgcagattcgcgaacgcatcgcccagctgcgcgccgaacgcgccaaggccactcaggtagcgcagcaaaaggccgccgaagccagctatcaggactgcctgaagcagcgctccagccttcaaaagctgtccggcatggtgggcatgagcggcaactgcgaaaagccctga

SEQ ID NO: 844 - protein, 343 aa, Unknown
  Obtained from environmental sample
  SIGNAL (1)...(29)
  DOMAIN (48)...(206): Patatin-like phospholipase
MRLNVFLRPLVCLSLLGLAACGSNPPSPAATPEPPTATTSAPPIKIGLALGGGAAKGFAHIGVIKMLEANGLTPSFVAGTSAGSVVGALYASGMNAFELQEKAVALDEAKIRDLQLSAGGLVLGQKLEDYVNEQVHRKPLEQMTKPFVAISTRLEDGERTVFARGNVGQAVRASSSVPGVFQPVTIGKYHYVDGGIVSPVPVDAVRNLGADIVIAVDISNKASGKTPANMLGALNQSIAIMGQKLGQAELARADIIIRPKVLDIGPADFAQRSHAIVEGEKAATALMPQIRERIAQLRAERAKATQVAQQKAAEASYQDCLKQRSSLQKLSGMVGMSGNCEKP

SEQ ID NO: 845 - DNA, 708 bp, Unknown
  Obtained from environmental sample
atgtcgcttcgctctgcttttcgtcgtcgtctcttgagtgcgatgataacggttgggttcctcaaccggttatcgaacagtctggcgctggccaaccccgacccggggaacccggagcgccccaccgcgccgcgcgcccaggcggcgacgctcctcgtcttcggcgacagcctctcggcgggctatggtctgcgcgccggtaacggttgggtcgatctcctcgcggagcggctgcaagcgtgcgcgccgcagtggcgcgtggtcaacgccagcgtttcgggggagacgacccacggcggccgggtgcggctaccgaaactgctcgcccgcgagcgagcccggttggtgatccttgaacttggcgcaaacgacggattgcgcggtctgtcgctcacggcgatgcgggaaaacctggctgcgatgatcgacgccgcacaccgtgctggcgcgcaagtggtgctcgttggcatgcagatcccgccaaaccttggccccgactacagcgaagcgttcgccgcgacctttgcggaattggcagcggaaaaacgggtagccggtttcgttccattccttttggcgcccattgcgctcaaccgtgacgcgttccaagccgatgggctccaccccaccgcggaagcgcagccgctgcttctcgaaacggtctggccggtggtggcaccgctcgttggctgcacgaccgcgccgtga

SEQ ID NO: 846 - protein, 235 aa, Unknown
  Obtained from environmental sample
  SIGNAL (1)...(31)
  DOMAIN (51)...(221): GDSL-like Lipase/Acylhydrolase
MSLRSAFRRRLLSAMITVGFLNRLSNSLALANPDPGNPERPTAPRAQAATLLVFGDSLSAGYGLRAGNGWVDLLAERLQACAPQWRVVNASVSGETTHGGRVRLPKLLARERARLVILELGANDGLRGLSLTAMRENLAAMIDAAHRAGAQVVLVGMQIPPNLGPDYSEAFAATFAELAAEKRVAGFVPFLLAPIALNRDAFQADGLHPTAEAQPLLLETVWPVVAPLVGCTTAP

SEQ ID NO: 847 - DNA, 408 bp, Unknown
  Obtained from environmental sample
atggcgctgatcgtcctcgtccatggagcgtggggaacgccggccgagctcgccccgatcgaaccggcactcacggcggcggggcacgaggtccggttcgtcgacctgccctgcaccgatcccgacgccacgttcgacgactacgtcgaggcggtgatcgcccagttggacccgcccgagcgcgaccccgagaccctgctggtggggcactcgttcggcggcgccaccatcggtctggtccgcgagcggcgacccgatgtggcactggtgtacgtcacggccgtggtgccggaaccggccagtcgctgctcgagatgctgctcggctccgatcccttcgacgaccccgacgtcgacgatccgtgggcggccctcggcggactcgtgctggacgcggggccggggttga

SEQ ID NO: 848 - protein, 135 aa, Unknown
  Obtained from environmental sample
MALIVLVHGAWGTPAELAPIEPALTAAGHEVRFVDLPCTDPDATFDDYVEAVIAQLDPPERDPETLLVGHSFGGATIGLVRERRPDVALVYVTAVVPEPASRCSRCCSAPIPSTTPTSTIRGRPSADSCWTRGRG

SEQ ID NO: 849 - DNA, 747 bp, Unknown
  Obtained from environmental sample
atgaaaattaaattgccagaaccatttacatttgaagcaggaaatcgagcagttttattattacatggatttactggccattcagcagatgtaagaatgcttggccgttatttagagaagaaaggttacacaacccatgcaccaatttatagagggcatggtcaagaaccagaagcgttactacactcatcacctgatgaatggtgggaggatattttaacagcttataatcatttaaaaaatctaggatataatgaaattgctgttgctggtctttcgatgggtggtgctttagcacttaaattagctattaaatatgagttaaaaggtgtcattcctatgtgtacaccaatgtattttgataatcaaaaacagttaactcaagcatttttatactttgcacgacaatttaaaaaatttgagaaaaaagatgaacaaacaattaaaaaagaagtagatttactacaacaaaattcagcagaattatttaatgaaatcggcacttttgtagaacaagtcaatggtataatagatagagttgacattcctacattcgtagttcaagcaagtaaagatgaaataataaatcctgaaagtgcaacatttatttatgaaaatattaaaaatgagaaaaaagatttaaaatggtatgaaaattctactcacttgataacattcggagatgagaaagatatcttacatgaagatatctataattttttagaaacattagattggaacaactaa

SEQ ID NO: 850 - protein, 248 aa, Unknown
  Obtained from environmental sample
MKIKLPEPFTFEAGNRAVLLLHGFTGHSADVRMLGRYLEKKGYTTHAPIYRGHGQEPEALLHSSPDEWWEDILTAYNHLKNLGYNEIAVAGLSMGGALALKLAIKYELKGVIPMCTPMYFDNQKQLTQAFLYFARQFKKFEKKDEQTIKKEVDLLQQNSAELFNEIGTFVEQVNGIIDRVDIPTFVVQASKDEIINPESATFIYENIKNEKKDLKWYENSTHLITFGDEKDILHEDIYNFLETLDWNN

SEQ ID NO: 851 - DNA, 948 bp, Unknown
  Obtained from environmental sample
atgacccaagtttatgtccgccccgatgtccgccgatttctcgattatctgaacgccctgcccgggccgcgcagccacgaagtggggccgaacgaggcgcggctgatgatgctcgcttcccggcaggtcgccgacgaacccgtgggagagttggcccatgtccgcgatctcgcctgccccggccccggcggcgagataaagctgcggctgttcgacgctcgcgaagagagagagccaggtcccttgctcgtcttcttccacggcggcggcttcgttctcggcgatctcgacacccatgcgcccttctgcgcggagattgcgcgcctgctcgacatgccggtgctcgccgtcgactatcgcctggcgcccgaaaatccctggccagccggcgccgaggattgcatcgccgcggcgcgctgggcggcttccagtcccgacgagctcgggcgagaggtcaccggcctggtcgtcgccggtgacagcgccggcgggaatttcgcgatcgtcgccagcctcgcgctccgcgacgagcctgccgcagtgccggttctcgcccagtggccgatctacccggcggccgatccgaccaagggctatccctcgttcgaggatttcgccgaaggctatttgctgacccgcgacggaatgcaatggttcgaccaatgttatgcggcggatggcaaggactggcgctattcgccgctggtcaagagccaggaaggcatgccgccgaccctggtgatcaccgccggcctggacccgatccgcgaccagggccgcgcctatgccgccgaatgcatccgcgccggcgtgcctaccaccttcctcgaagcgaagggcaatatccacggcttcatcaatcttcggaaggcgatcccatcctcggtcgaggacatcaggggctgcgtcgcggtgctgaagcagatgctggaggagtcggcacgatga

SEQ ID NO: 852 - protein, 315 aa, Unknown
  Obtained from environmental sample
MTQVYVRPDVRRFLDYLNALPGPRSHEVGPNEARLMMLASRQVADEPVGELAHVRDLACPGPGGEIKLRLFDAREEREPGPLLVFFHGGGFVLGDLDTHAPFCAEIARLLDMPVLAVDYRLAPENPWPAGAEDCIAAARWAASSPDELGREVTGLVVAGDSAGGNFAIVASLALRDEPAAVPVLAQWPIYPAADPTKGYPSFEDFAEGYLLTRDGMQWFDQCYAADGKDWRYSPLVKSQEGMPPTLVITAGLDPIRDQGRAYAAECIRAGVPTTFLEAKGNIHGFINLRKAIPSSVEDIRGCVAVLKQMLEESAR

SEQ ID NO: 853 - DNA, 1098 bp, Unknown
  Obtained from environmental sample
atgacgtttgttttgacgatactgggcatcctggctgcggtcgttggcgtgtttctgcttctcgcctggctttttcgtcgcggcgagaatctgtcccgttacgacacgcccgtcgatccggccgcgctcgaatcctgcggtgatccggacggccccagcgcgggccatgccggcgccgtcgcggcgatcgaaaagctgcgcccgcaggccgaagggctctcccgcggcggaatgatccggttcgcccggcaattcatggaggatataccgaccggccgtcggttcgattgcgagtttcggccggtcgaagccgctggcgttcgctgcgaatgggtgctggcgcccggcgcggatccggaacgccgtgtactttacctgcacggcggcgcattcatcgccggcagccctcacagccaccgaacggcgacctgccggttttcgaccgtcgcccgagcggcggtgctggcggtcgactaccgactgatgccggagcattcgcggcaggacctcattcaggactgccaggcggcataccgctggctgctcgaccacgggccgcacgggccggctgcggctcaacgggtgtatttcggcggcgactccgccggcggcaatctcgcgctgacgctgtccaactggacgcgggacgccgggctgcgccagcccgacgccgtcgtggccctgtcgccgttgacggattcgacttacagcagcccgagcatccgcggcaacctggccaccgataccctgatctcgaccctgttcgggcggctggcgcgcgtgccgcaaagcgtgctgacctggatgttcgtgctggataaccgcatccgcccggtcgatcccctggtctcgccgtcgcggggcgacctgtcgggcctgccacccacgctgcttcaggtgagcgaatccgagatgctgtacgacgacgcccgtcgctacgtgaacaaggccgtggcggctggttcaccggcccgtctgcagagctggccgggactgctgcacgtctggcagctgttctaccccgagatccccgaggccgggcaggcctggcgccgggtcggcgagttcatcgaggcggtcgacgcggaaagcgcttag

SEQ ID NO: 854 - protein, 365 aa, Unknown
  Obtained from environmental sample
  SIGNAL (1)...(22)
MTFVLTILGILAAVVGVFLLLAWLFRRGENLSRYDTPVDPAALESCGDPDGPSAGHAGAVAAIEKLRPQAEGLSRGGMIRFARQFMEDIPTGRRFDCEFRPVEAAGVRCEWVLAPGADPERRVLYLHGGAFIAGSPHSHRTATCRFSTVARAAVLAVDYRLMPEHSRQDLIQDCQAAYRWLLDHGPHGPAAAQRVYFGGDSAGGNLALTLSNWTRDAGLRQPDAVVALSPLTDSTYSSPSIRGNLATDTLISTLFGRLARVPQSVLTWMFVLDNRIRPVDPLVSPSRGDLSGLPPTLLQVSESEMLYDDARRYVNKAVAAGSPARLQSWPGLLHVWQLFYPEIPEAGQAWRRVGEFIEAVDAESA

SEQ ID NO: 855 - DNA, 831 bp, Unknown
  Obtained from environmental sample
atgggcattgtgaacgcgggtgcccgtgggttgatcctgcgggcgcttgcggctgtcctggcgttggcgctgggctgctgctgtgtgccggtgcgttccgagcggacgcggaatattgttttcacgccggcggactggccggcggcggttccgggcgatttctatcgtccggcgggggatggtccgtggccggcggtgttgctggtgcatggcggcggttggtcgggcggcgatacccgctggcacatgaaccggatcgcgcggaagctggcgcgccggggatattttgttttaaatgtcacctaccggcagtcaccggagtggacctatccggcagcggtggaggatgtgcgggagggatttcagtggttgcggcgcaactcgcgggagcaggggatcgatccggagcggatcgccattttcggttattcggccggcgggtatctggggtcgatggtggccttgcgggacaaccccggcgtgcgggcggtggtggcgggcggaacgccgttcgatctgagtttttatcgggacggcgatctggtggcggattttcttggagcgagatattatgaagagccggagcggtttcatgaagcatcgccggtgaatcatgtgaaacccgacagtccgccatttttcatttatcacggggagaatgacagtttggtgaaaccggagcacccgcatgcgatgattgcggagctggcaattcaccaggttcctcacgaggttttctggatcccgggacgcgggcacatcggagcgttttttcgtcccgcgggcgcggtggatggggcgatcgatttcctggacaggaaattgaagtga

SEQ ID NO: 856 - protein, 276 aa, Unknown
  Obtained from environmental sample
  SIGNAL (1)...(33)
  DOMAIN (50)...(275): Dienelactone hydrolase family
MGIVNAGARGLILRALAAVLALALGCCCVPVRSERTRNIVFTPADWPAAVPGDFYRPAGDGPWPAVLLVHGGGWSGGDTRWHMNRIARKLARRGYFVLNVTYRQSPEWTYPAAVEDVREGFQWLRRNSREQGIDPERIAIFGYSAGGYLGSMVALRDNPGVRAVVAGGTPFDLSFYRDGDLVADFLGARYYEEPERFHEASPVNHVKPDSPPFFIYHGENDSLVKPEHPHAMIAELAIHQVPHEVFWIPGRGHIGAFFRPAGAVDGAIDFLDRKLK

SEQ ID NO: 857 - DNA, 945 bp, Unknown
  Obtained from environmental sample
gtgctggccgcggctgcgaccgcggtcgtcgtgctcgcgacgtcgcacgacgtcgacgcgaacccgaccgtgcggctcgtctgcacggagacgtgcgtcgcgctcgatcccatcccgatccgcggcaaggtcgatctgctcgtgctcggcgacgcgccgccgtcgacgcggttcggcacgcacgcgctgacgtcgacggacggggtgcggcgcgccgacggcgttccggtgtcgtcgctcaacatcgtcggccgcgagccgccgtcgcgcctcgtcgggcccgacatcatcgaggcgggcgacgactccgccgacgacgacgatgacgtcttcgacgatgcggtgctggtcggcggtccgcgcggctatcgctgctcgggcgtcgtcatcgaccccacgcacgtgctcaccgcggcgcactgcgcacctgccacgcacgtcggcatcggcgtcgaggccgaccgcgcgaaacgcatcgacgtgacgcgcagcgatctccatccgcgcctcgacgtcgcgctgctcacgctggcgacgccggtgacggtccacgtgcatcgtcgccgcggcgccggcgataccgccccgccggccggccgcgttcgcatcctcggctacggcgtgcgcgacgcgctgcgcttcaccggcttcggcacccgccgccaggtcgaccttaccgtcgacggctggggctgcccggtcctccgcgccgccgccctcggctgccgctccggcgtcgagatgcacctgcgcgacggcgccggcaacgacacctgcttcggcgacagcggcggccccgtcttcgagtcgaccctcgacggctggcgcctcatcgcgatcacgtcccgcggggcccagcctcgcaaggtcctctgcggcgaaggcggcatctacacccgcatcgaccgcctcgccccctggctccgagaggtcacgtccccatga

SEQ ID NO: 858 - protein, 314 aa, Unknown
  Obtained from environmental sample
  SIGNAL (1)...(20)
  DOMAIN (104)...(308): Trypsin
MLAAAATAVVVLATSHDVDANPTVRLVCTETCVALDPIPIRGKVDLLVLGDAPPSTRFGTHALTSTDGVRRADGVPVSSLNIVGREPPSRLVGPDIIEAGDDSADDDDDVFDDAVLVGGPRGYRCSGVVIDPTHVLTAAHCAPATHVGIGVEADRAKRIDVTRSDLHPRLDVALLTLATPVTVHVHRRRGAGDTAPPAGRVRILGYGVRDALRFTGFGTRRQVDLTVDGWGCPVLRAAALGCRSGVEMHLRDGAGNDTCFGDSGGPVFESTLDGWRLIAITSRGAQPRKVLCGEGGIYTRIDRLAPWLREVTSP

SEQ ID NO: 859 - DNA, 909 bp, Unknown
  Obtained from environmental sample
atggctgttcagattaaacaaggacgcattggctttattggggatgatccaatcgaatcacgccgacaattcgatgcgcaaatgttggcgattttaaataaatcaacatcgattgattcagttgaagatattcgcttaccactacaaagtggaactgttttcgcaagacactatcatcctgcaccaaataaaaaacttccaatgattgtattttatcatggaggaggttttgttgtgggtggtttagatactcatgatgaagcctgtcgactcattgccaaatatgcaaaagtacaagttttaagtattgactatccacttgcgccagaagtgtcgccgcaactcctaattaaatcatgtgaagatgcattagcatgggtttatcaaaaccgccgtcagttgaaaatttataaaaaccgtattgcggttgctggcgatagcgcaggtggaaatattagtactgttgttgcacagcatgccgcaggtaagtcttacgcaccgcaagcacaattacttatttatccagttgtcgatttcaaaagtcgacatccttcattttatgcatatggcgaagggctggtgttaacaagtaaagatgtagactacgttacggattactatgcaacgcagcacaatgttgctttggatgacgcacttatttctccaacttatggcagttttaaaaagcttgcgccagcatacgtgattactgctggacatgacttactgcatgatgaaggtgagatatatagccataagctcagacaaagcggtgttaaagtgcaatacatcgattaccctgaacaaactcacggttttattaatctgactccaatctcgagcaaggctaaacggaatacgatcgaaattgccaaaagcttcagaaagttttgggataagcatcactga

SEQ ID NO: 860 - protein, 302 aa, Unknown
  Obtained from environmental sample
MAVQIKQGRIGFIGDDPIESRRQFDAQMLAILNKSTSIDSVEDIRLPLQSGTVFARHYHPAPNKKLPMIVFYHGGGFVVGGLDTHDEACRLIAKYAKVQVLSIDYPLAPEVSPQLLIKSCEDALAWVYQNRRQLKIYKNRIAVAGDSAGGNISTVVAQHAAGKSYAPQAQLLIYPVVDFKSRHPSFYAYGEGLVLTSKDVDYVTDYYATQHNVALDDALISPTYGSFKKLAPAYVITAGHDLLHDEGEIYSHKLRQSGVKVQYIDYPEQTHGFINLTPISSKAKRNTIEIAKSFRKFWDKHH

SEQ ID NO: 861 - DNA, 1188 bp, Unknown
  Obtained from environmental sample
atgcagcgctggacacttctgttttcattgacgctctgctccgccatgacggcgcccgctgtgtgggccgcacccgtgtgggtcactgcctggacggccgcgcccgcgcccgaccgcaaggacggaacgtccgatgcgccggtacagttcgccgcacagaccgtgcgccaggacatgcgtatcggcagccgtggcgatgcgctgcggctgcgcatcagcaacgagctcggcacggcgcccttgcgggtcgaggacctgcgtgtgggagtgaagaacggcaaggccgcaccgctgccggtaacggtggatggccgcgcggtcatcgaggtgccggtcggagccgcgctgctgagcgacccggtgcggatgccggtggcggcgctgcaggagatcagcgtgagtgcctatttcccgcagcccacccgccccgccgtgcgccgcaccgagctgcgggtcgcagatggcaggcagacagccgtcgccgacagcgtgcggctgagctaccagcagaacgtgttctcggcagtgatggtgcagcgtgatgatcgtccccaggtaatcgtggcgctgggcgattccatcacggaaggcgccaccgcacgccgcggcaccttcaaccagtggccggagcggttggcgcagcgcctgcagcaggcctgcccgaaccggttcgtggtacttaaccagggcatcagcggcaacaagctgcttgaccacggccgcagccacagtgcgctgtcacgattggatcgcgatgtgatcgcggtggccgacgccgatcaggtgatcctgttcgaaggcatcaacgacatccgccacggcggtggcgcgcagccgctgcctggacgcaatgcggcggacatgctgctgggctatcaacaggttgcggcgcggctgcatgcgcacggcatccgcgcctggctgggtacgctgaccccgttcggcggttccgagcgctacgagcccgtgtccgccgccacccgcaccacgatcaaccagtgggcacgcggcggcaacagcggcttcgacggcatcatcgatttcgatgccgcgctgcgtgacccgaaggcagccgaatcgttgcccaacgagatcacccgcgaccatctgcatcccaacgacgaaggctaccggcgcatggccgatgccatcgatctgcgcatgctgggctgcaccacccccgagtga

SEQ ID NO: 862 - protein, 395 aa, Unknown
  Obtained from environmental sample
  SIGNAL (1)...(23)
  DOMAIN (187)...(384): GDSL-like Lipase/Acylhydrolase
MQRWTLLFSLTLCSAMTAPAVWAAPVWVTAWTAAPAPDRKDGTSDAPVQFAAQTVRQDMRIGSRGDALRLRISNELGTAPLRVEDLRVGVKNGKAAPLPVTVDGRAVIEVPVGAALLSDPVRMPVAALQEISVSAYFPQPTRPAVRRTELRVADGRQTAVADSVRLSYQQNVFSAVMVQRDDRPQVIVALGDSITEGATARRGTFNQWPERLAQRLQQACPNRFVVLNQGISGNKLLDHGRSHSALSRLDRDVIAVADADQVILFEGINDIRHGGGAQPLPGRNAADMLLGYQQVAARLHAHGIRAWLGTLTPFGGSERYEPVSAATRTTINQWARGGNSGFDGIIDFDAALRDPKAAESLPNEITRDHLHPNDEGYRRMADAIDLRMLGCTTPE

SEQ ID NO: 863 - DNA, 1038 bp, Unknown
  Obtained from environmental sample
atgacaacccaatttagaaacttgatctttgaaggtggtggtgtaaaaggagttgcttacattggcgccatgcagattcttgaaaatcgtggcgtgttgcaagatattcaccgagtcggaggttgcagtgccggtgcgattaacgcgctgatttttgcgctgggttacacggttcgtgagcaaaaagagatcttacaagccaccgattttaaccagtttatggataactcttggggggttattcgtgatattcgcaggcttgctcgagactttggctggaataagggtggcttctttaatagctggataggtgatttgattcatcgtcgtttggggaatcgccgagcgacgttcaaggatctgcaaaaggccaagcttcctgatctttatgtcatcggtactaatctgtctacagggtttgcagaggttttttctgccgaaagacaccccgatatggagctagcgacagcggtgcgcatctccatgtcgataccgctgttctttgcggccgtgcgccacggtgatcgacaagatgtgtatgtcgatggaggtgttcaacttaactatccgattaaactgtttgatcgggagcgttatattgatctggccaaagatcccggtgccgttcggcgaacgggttattacaataaagaaaacgctcgctttcagcttgaacggccgggccatagcccctatgtttacaatcgccagaccttgggtttgcgactggatagtcgagaggagatagggctttttcgttatgacgaacccctcaagggcaaaccgattaagtccttcactgactacgctcgacaacttttcggtgcgttgatgaatgcgcaggaaaacattcatctacatggcgatgattggcagcgcacggtctatatcgacacactggatgtgagtacgacggacttcaatctttctgatgcaaccaagcaagcactgattgagcaaggaattaacggcaccgaaaattatttcgagtggtttgataatccgttagagaagcctgtgaatagagtggagtcatag

SEQ ID NO: 864 - protein, 345 aa, Unknown
  Obtained from environmental sample
  DOMAIN (8)...(195): Patatin-like phospholipase
MTTQFRNLIFEGGGVKGVAYIGAMQILENRGVLQDIHRVGGCSAGAINALIFALGYTVREQKEILQATDFNQFMDNSWGVIRDIRRLARDFGWNKGGFFNSWIGDLIHRRLGNRRATFKDLQKAKLPDLYVIGTNLSTGFAEVFSAERHPDMELATAVRISMSIPLFFAAVRHGDRQDVYVDGGVQLNYPIKLFDRERYIDLAKDPGAVRRTGYYNKENARFQLERPGHSPYVYNRQTLGLRLDSREEIGLFRYDEPLKGKPIKSFTDYARQLFGALMNAQENIHLHGDDWQRTVYIDTLDVSTTDFNLSDATKQALIEQGINGTENYFEWFDNPLEKPVNRVES

SEQ ID NO: 865 - DNA, 936 bp, Unknown
  Obtained from environmental sample
atgccactcgatcctcaaattcaagcctatctcgatcagatggcggcaatgaatatgcccccgatacatacgatgacgcccgaacaggtacgaatgggaatagcgatgcagcttgcgatggagaacattgagaaagagcaggtggctcgcgttgagaaccgcaccattcccggcccggcgggcgagatacctgtgcgcatctacacgccgcagggcaacgggcctttcccggctctggtcttctttcacggcggcggctgggtgatctgtaacctagacacgcacgatggtatctgccgcagcctggcaaacggcgcggactgcgtggtcgtctcggtcgattaccggctcgcgcccgaacacaaatttcctgccgcgcccgaagattgctatgccgcgacgcaatgggtggcgaagaacgcggcagagttgaacgtggaggcatccaacattgccatcggcggggatagcgcgggcggcaatctcactgccgtcgtggcgcagatggcgcgagatcggggaggcccgcatctcgtcttccagttgctaatctatcccgccaccgatttcaggatgaacacgccctccatcgaagagaacgccaccggctacttcctgacgaaagacgacatgatctggttcacgaaccattacctgaacagcgaagaggataagacgaacccgctggcctcccccctgctggcgagcgatctgagcggcctgcccccggcccttatcatcaccgcccagtacgaccccctgcgcgacgagggtgagttgtacgggcagaaattacgggaagcaggcgtccccgtcaccgtcagccgctacgaaggggttattcatggctttttcggcagcattccctccgataagggcaagcaggccgaggccgaagccagcgccgccctgcgtctggcctttggcaaagcgtag

SEQ ID NO: 866 - protein, 311 aa, Unknown
  Obtained from environmental sample
MPLDPQIQAYLDQMAAMNMPPIHTMTPEQVRMGIAMQLAMENIEKEQVARVENRTIPGPAGEIPVRIYTPQGNGPFPALVFFHGGGWVICNLDTHDGICRSLANGADCVVVSVDYRLAPEHKFPAAPEDCYAATQWVAKNAAELNVEASNIAIGGDSAGGNLTAVVAQMARDRGGPHLVFQLLIYPATDFRMNTPSIEENATGYFLTKDDMIWFTNHYLNSEEDKTNPLASPLLASDLSGLPPALIITAQYDPLRDEGELYGQKLREAGVPVTVSRYEGVIHGFFGSIPSDKGKQAEAEASAALRLAFGKA

SEQ ID NO: 867 - DNA, 1245 bp, Unknown
  Obtained from environmental sample
atgaaggtacccacgacagttttgccgatgaaaggcatgcgcaaaatcttcatcgccgtgctggccgcaggtgcggccaatttgccggcaagcgcactgggatacggtacgcgtgaattgccggttccacaaacggcgagccgggagatgcaggcagtgattgcagccggtctgctgccatactggaacacccatcccagaaccgttcaggaatggaaatcctgggtcgaccagttggcgcaagacactgtccagacgctgcccgcactgcaaaaagcactggatgtcagcgtggagccgttgcagatggctggtgtgccggtcttcatcgtcacaccccggtcggtcgcaccgcaaaaccgccatcgtttgctgatccattttcatggcggcggctatgtattgaaccccggaaaagcgggcacggccgaggccatcatgatggccgggtacggaaaaatccgggttgtttccgtggactaccggatgccgccggattttccctatcccgccgccatcgacgacgcgctgactgtgtaccgcgaaatcattcaaaaacgcagtcccgacacgattggcgtatttggcacttccacaggcggcgcaatgacgctggctttaatgctgcgggcgaaagacgaaaagttgccactgccgggtgccattgctgtcgggaccccttggacggacttgaccaaaacgggagacagctatttcacgaatgacggcgtggataacgtgctggtgcgttatgaaggttggctgggagatgcggcgaagctctatgccggagagcacgatcccaaacacccttacctttctcccgtatatggcgacgtacacggtttgccgcccacgttgctcgtttccggaacgcgcgatttgtttttgagcaatacggtgcgtatgcactggcggcttcgcgatgcggacgtgccagcggatctgctggtttttgaggggctgtcgcacgcccaatacctgatgtctgtgggtgcgccggaaaccagacagtattttgacgcgctttcccggtttttcgatattcgtctcgccggtcctgccgcttcgggagggagagttggaatggaagatggaatggtgcattggagaagcgtattaaccggaacagatcaaaggcaagaggcggatcaattcaaggagaaatacgatgacaatcaagggcgaggtcaaataccccttgtcattgatgactcttcacttgcgaatcaagcttcgatttga

SEQ ID NO: 868 - protein, 414 aa, Unknown
  Obtained from environmental sample
  SIGNAL (1)...(32)
MKVPTTVLPMKGMRKIFIAVLAAGAANLPASALGYGTRELPVPQTASREMQAVIAAGLLPYWNTHPRTVQEWKSWVDQLAQDTVQTLPALQKALDVSVEPLQMAGVPVFIVTPRSVAPQNRHRLLIHFHGGGYVLNPGKAGTAEAIMMAGYGKIRVVSVDYRMPPDFPYPAAIDDALTVYREIIQKRSPDTIGVFGTSTGGAMTLALMLRAKDEKLPLPGAIAVGTPWTDLTKTGDSYFTNDGVDNVLVRYEGWLGDAAKLYAGEHDPKHPYLSPVYGDVHGLPPTLLVSGTRDLFLSNTVRMHWRLRDADVPADLLVFEGLSHAQYLMSVGAPETRQYFDALSRFFDIRLAGPAASGGRVGMEDGMVHWRSVLTGTDQRQEADQFKEKYDDNQGRGQIPLVIDDSSLANQASI

SEQ ID NO: 869 - DNA, 1422 bp, Unknown
  Obtained from environmental sample
atgaaaaagaaattatgtacatgggctctcgtaacagcgatatcttctggagttgttgcgattccaaccgtagcatctgcttgcggaatgggtgaagtaatgaaacaggaggatcaagagcacaaacgtgtgaagagatggtctgcggagcatccgcaccatgctaatgaaagcacgcacttatggattgctcgaaatgcgattcaaattatgagtcgtaatcaagataagacggttcaagaaaatgaattacaattcttaaaaatacctgaatataaggagttatttgaaagagggctttatgatgccgattatcttgatgagtttaacgatggaggtacaggtacaatcggtattgatgggctaattaaaggaggctggaaatctcatttctatgatcctgatacgaaaaagaactataaaggagaagaagaaccaacagccctttcgcaaggagataaatattttaaattagcaggagattattttaagaaagaagattggaaacaagctttctattatttaggtgttgcgacgcattacttcacagatgctactcagccaatgcatgctgctaattttacagctgtcgacacgagtgcaataaagtttcatagcgcttttgaaaattatgtaacgacagttcagacaccgtttgaagtgaaggatgataagggaacatataatttggtcaattctgatgatccgaagcagtggatacatgaaacagcgaaactcgcaaaagcagaaattatgaatattactagtgataatattaaatctcaatataataaaggaaacaaagatctttggcaacaggaagttatgccagctgtccagaggagtttagagaaagcgcaaagaaacacggcgggatttattcatttatggtttaaaacatatgttggcaaaactgcagctgaagatattgaaactacacaggtaaaagattctaatggagaagcaatacaagaacaaaaaaaatactacgttgtgcctagtgagtttttaaatagaggtttgacctttgaggtatatgcttcgaatgactacgcactattatctaatcacgtagatgataataaagttcatggtacacctgttcagtttgtttttgataaagagaataacggaattgttcatcggggagaaagtgtactgctgaaaatgacgcaatctaactatgatgattatgtatttcttaattactctaatatgacaaattggttacatcttgcgaaacgaaaaacaaatactgcacagtttaaagtgtatccaaatccggataactcatctgaatatttcctatatacagatggatacccggtaaattatcaagaaaatggtaatggaaagagctggattgagttaggaaagaaaacggataaaccgaaagcgtggaaatttcaacaggcggaataa

SEQ ID NO: 870 - protein, 473 aa, Unknown
  Obtained from environmental sample
  SIGNAL (1)...(20)
  DOMAIN (1)...(303): Zinc dependent phospholipase C
MKKKLCTWALVTAISSGVVAIPTVASACGMGEVMKQEDQEHKRVKRWSAEHPHHANESTHLWIARNAIQIMSRNQDKTVQENELQFLKIPEYKELFERGLYDADYLDEFNDGGTGTIGIDGLIKGGWKSHFYDPDTKKNYKGEEEPTALSQGDKYFKLAGDYFKKEDWKQAFYYLGVATHYFTDATQPMHAANFTAVDTSAIKFHSAFENYVTTVQTPFEVKDDKGTYNLVNSDDPKQWIHETAKLAKAEIMNITSDNIKSQYNKGNKDLWQQEVMPAVQRSLEKAQRNTAGFIHLWFKTYVGKTAAEDIETTQVKDSNGEAIQEQKKYYVVPSEFLNRGLTFEVYASNDYALLSNHVDDNKVHGTPVQFVFDKENNGIVHRGESVLLKMTQSNYDDYVFLNYSNMTNWLHLAKRKTNTAQFKVYPNPDNSSEYFLYTDGYPVNYQENGNGKSWIELGKKTDKPKAWKFQQAE

SEQ ID NO: 871 - DNA, 987 bp, Unknown
  Obtained from environmental sample
atgaacaataagaagtttattttgaagttattcatatgtagtatggtacttagcgcctttgtatttgctttcaatgataagaaaaccgttgcagctagctctattaatgagcttgaaaattggtctagatggatgaaacctataaatgatgacataccgttagcacgaatttcaattccaggaacacatgatagtggaacgttcaagttgcaaaatccgataaagcaagtgtggggaatgacgcaagaatatgattttcgttatcaaatggatcatggagctagaatttttgatataagagggcgtttaacagatgataatacgatagttcttcatcatgggccattatatctttatgtaacactgcacgaatttataaacgaagcgaaacaatttttaaaagataatccaagtgaaacgattattatgtctttaaaaaaagagtatgaggatatgaaaggggcggaaagctcatttagtagtacgtttgagaaaaattattttcgtgatccaatctttttaaaaacagaagggaatataaagcttggagatgctcgtgggaaaattatattactaaaacgatatagtggtagtaatgaatctgggggatataataatttctattggccagacaatgagacgtttacctcaactataaatcaaaatgtaaatgtcacagtacaagataaatataaagtgagttatgatgagaaagtaaacgctattaaagatacattaaatgaaacgattaacaatagtgaagatgttaatcatctatatattaattttataagcttgtcttctggtggtacagcatggaatagtccatattattatgcgtcctacataaatcctgaaattgcaaattatatgaagcaaaagaatcctacgagagtgggctggataatacaagattatataaatgaaaaatggtcaccattactttatcaagaagttataagagcgaataagtcacttgtaaaatag

SEQ ID NO: 872 - protein, 328 aa, Unknown
  Obtained from environmental sample
  SIGNAL (1)...(23)
  DOMAIN (56)...(195): Phosphatidylinositol-specific phospholipase C, X domain
MNNKKFILKLFICSMVLSAFVFAFNDKKTVAASSINELENWSRWMKPINDDIPLARISIPGTHDSGTFKLQNPIKQVWGMTQEYDFRYQMDHGARIFDIRGRLTDDNTIVLHHGPLYLYVTLHEFINEAKQFLKDNPSETIIMSLKKEYEDMKGAESSFSSTFEKNYFRDPIFLKTEGNIKLGDARGKIILLKRYSGSNESGGYNNFYWPDNETFTSTINQNVNVTVQDKYKVSYDEKVNAIKDTLNETINNSEDVNHLYINFISLSSGGTAWNSPYYYASYINPEIANYMKQKNPTRVGWIIQDYINEKWSPLLYQEVIRANKSLVK

SEQ ID NO: 873 - DNA, 1641 bp, Unknown
  Obtained from environmental sample
atgagaagactgttgctggggggagtgatcgctgcggcgatcgtggccgtggccccggggatgcaggcggcgctgccggatccggtcacgatcgacagcggtcgagtgtccggcaccgcgacgtcctcgcccgacgtccgcgccttccggggcattccgttcgcggcgcctccgctgggcgagaaccggtggcgggcgccggggccgccggcgacgtgggatggtgtgctcgaagctcatgccttcggtccgaattgcctggccggtgcgcccggcggcgggcgtggtcgcggcgcgccggctgccgcgcccgccgcggcggctccggcggcaccgggcgcacgcggcgccgcccccgcggcaccgggcggcggcccggggggagcgcccgcggccagtgaggactgcctccacatcaacgtctggaccggtgcgagcagtccctccgagcgccggccggtcatgatgtggatctacggcggcggcttcacgggcggctcgagctcgcaggggtggtacgacggcgaacagctcgcggccaagggcgccgtggtcgtcaccttcaactaccggctgggcgccttcggcttctttgcgcaccccgacctggcgcgcgagtcggggcgcaacgccgcaggcaactacgggatgatggacgccatcgcggcgctccagtggattcagcgcaacatcgccgccttcggcggcgacccgaccaacgtcacggtgttcggcgagtcggccggcgccatcatgacggcggcgctcgtcggctccccgcaggcaaagggcctgttccaccgcgccatcctgcagagcggcggctggatgggcctgcagatgaaccggatgacgaccggtgcgcaggcccaggccaacggcgtgaaggccctgcaggcgctcaatgcctcgtccgtcgccgagctgcgcacgcggccgctcgccgagctggcgggcctcaccggcagcgggctcgtcgtggacggctacctcgtgccggaagacctctcgatcaccttcgcccagggacgtcagaacccggtggacatcatgaccgggtcgaaccgggacgaggcgaccttcttcggcggaggccagcggacggtcgacgtgcaccaggcgcaggcgacgcagcggttcggcgacctcgcccccgagtacctgaagctctatcccgcctcgtccgacgcgcaggcggtgacctcctacaacgacgcctacgcccacgaaaccagctggcacatgcggctggccgcccaggcacaggcgcgggaggggaagcacgcgtacgtgtactacttcacgcgcgtcccgctcgacgccggcggacagccctcgccgcgcggggcgacgcatacggccgagatccgctacgccttcaacacccaggacggccaggtgtgggacgacaccgatcgccggctggccgacgcgatgtcgacctactgggtcaacttcgcgcgcacgggcaacccgaacggcaacagcctgccggactggcccgcgttccgcgacatggcgagcggccgggcactcgtgcttggcgaccgcatcgaggtggaagcgtcgccgttcacggcaccgctcgccttcttcgaccgcgcctaccagcggctgatgcagcagatccaggccgactga

SEQ ID NO: 874 - protein, 546 aa, Unknown
  Obtained from environmental sample
  SIGNAL (1)...(22)
  DOMAIN (1)...(532): Carboxylesterase
MRRLLLGGVIAAAIVAVAPGMQAALPDPVTIDSGRVSGTATSSPDVRAFRGIPFAAPPLGENRWRAPGPPATWDGVLEAHAFGPNCLAGAPGGGRGRGAPAAAPAAAAPAAPGARGAAPAAPGGGPGGAPAASEDCLHINVWTGASSPSERRPVMMWIYGGGFTGGSSSQGWYDGEQLAAKGAVVVTFNYRLGAFGFFAHPDLARESGRNAAGNYGMMDAIAALQWIQRNIAAFGGDPTNVTVFGESAGAIMTAALVGSPQAKGLFHRAILQSGGWMGLQMNRMTTGAQAQANGVKALQALNASSVAELRTRPLAELAGLTGSGLVVDGYLVPEDLSITFAQGRQNPVDIMTGSNRDEATFFGGGQRTVDVHQAQATQRFGDLAPEYLKLYPASSDAQAVTSYNDAYAHETSWHMRLAAQAQAREGKHAYVYYFTRVPLDAGGQPSPRGATHTAEIRYAFNTQDGQVWDDTDRRLADAMSTYWVNFARTGNPNGNSLPDWPAFRDMASGRALVLGDRIEVEASPFTAPLAFFDRAYQRLMQQIQAD

SEQ ID NO: 875 - DNA, 918 bp, Bacteria
atgcccctagatcctagaattaaaaagttactagaatcagctcttactataccaattggtaaagccccagtagaagaggtaagaaagatatttaggcaattagcgtcggcagctcccaaagtcgaagttggaaaagtagaagatataaaaataccaggcagtgaaaccgttataaacgctagagtgtattttccgaagagtagcggtccttatggtgttctagtgtatcttcatggaggcggttttgtaataggcgatgtggaatcttatgacccattatgtagagcaattacaaatgcgtgcaattgcgttgtagtatcagtggactataggttagctccagaatacaagtttccttctgcagttatcgattcatttgacgctactaattgggtttataacaatttagataaatttgatggaaagatgggagttgctattgcgggagatagtgctggaggaaatttggcagcggttgtagctcttctttcaaagggtaaaattaatttgaagtatcaaatactggtttacccagcggtaagtttagataacgtttcaagatccatgatagagtactctgatgggttcttccttaccagagagcatatagagtggttcggctctcaatacttacgaagccctgcagatttgctagactttaggttctctccaattctggcgcaagatttcaacggattacctccagccttgataataacagcagaatacgatccactaagggatcaaggagaagcgtatgcaaataaaatactacaagctggagtctcagttactagtgtgagatttaacaacgttatacacggattcctctcattctttccgttgatggagcaaggaagagatgctataggtctgatagggtctgtgttaagacgagtattttatgataaaatttaa

SEQ ID NO: 876 - protein, 305 aa, Bacteria
MPLDPRIKKLLESALTIPIGKAPVEEVRKIFRQLASAAPKVEVGKVEDIKIPGSETVINARVYFPKSSGPYGVLVYLHGGGFVIGDVESYDPLCRAITNACNCVVVSVDYRLAPEYKFPSAVIDSFDATNWVYNNLDKFDGKMGVAIAGDSAGGNLAAVVALLSKGKINLKYQILVYPAVSLDNVSRSMIEYSDGFFLTREHIEWFGSQYLRSPADLLDFRFSPILAQDFNGLPPALIITAEYDPLRDQGEAYANKILQAGVSVTSVRFNNVIHGFLSFFPLMEQGRDAIGLIGSVLRRVFYDKI

SEQ ID NO: 877 - DNA, 828 bp, Unknown
  Obtained from environmental sample
atgagaaaagaaaaaccggaatatggcattgtgctgagtggtggaggcgcccgcggaattgcccacattggtgtgctagctgcactggaaaagcacgggatcagtccgggtgtcgtttccggctctagcatgggcgccatcgtaggcgcattatacgccgggggggtgagcactgaagaaatgcttgaaatcgcccggaaccggaagcttaacgacctcttcgaatggtcgttcaaaaagcatggcggtatgctttcattaaagatgctcatgcaggttcttgaaacacatatccctgaaaattctttcgaatcgttaaagaaaaagttattcattaccgtatccaatatttcatccggccaggaggaggtcatttcagaaggtaagttgtaccaggcagtggtagcatcggcttctatcccgatcatttttgagcctcagctgatcaatggccagacttatgtcgatggcggcctgttcaacgatctgccggttgatccactgataggaaagtgcaggagtatcatcgcttcacatgtgaactacaatggtccgaatcctgatctgaccagtattcgcgccatcgcagaacgggtttaccgcctggctatttatcaacatgtacataagaatttcagcaaatgtgattatattattgacccgcccgcgttgagggatcatagcatttttgatttcaagcatatcgaccggttgtttgagatcgggtttgaagcggctgagatccttattacccagatgcaggaaccatcagttgaaaaaccgcttataatccgggaaattaagtccactaaaaagagattaaaatga

SEQ ID NO: 878 - protein, 275 aa, Unknown
  Obtained from environmental sample
  DOMAIN (10)...(169): Patatin-like phospholipase
MRKEKPEYGIVLSGGGARGIAHIGVLAALEKHGISPGVVSGSSMGAIVGALYAGGVSTEEMLEIARNRKLNDLFEWSFKKHGGMLSLKMLMQVLETHIPENSFESLKKKLFITVSNISSGQEEVISEGKLYQAVVASASIPIIFEPQLINGQTYVDGGLFNDLPVDPLIGKCRSIIASHVNYNGPNPDLTSIRAIAERVYRLAIYQHVHKNFSKCDYIIDPPALRDHSIFDFKHIDRLFEIGFEAAEILITQMQEPSVEKPLIIREIKSTKKRLK

SEQ ID NO: 879 - DNA, 939 bp, Unknown
  Obtained from environmental sample
atgaccctgccggtcggcgccctgctcgcggtggcggcgccggccagcgtagccgacgcggagatcgacgcctttgtcgccgccttcgtcgcgcccgaggcggcgccggaagacgcggcggaggcggaaagcgccttcgcaccgcgcgacatcgaggccggcggccggcggctgcgcgtgctcgatctcggcggcgaggccggccgcgggggaccgccgctcgtgctggtgcacgggttcggcgccgacctcaacgcgtggatgttcaaccagccggcactggccgccagccggcgcacggtcgcgctcgaactgccgggccacggcggttccgacaaacaggtcggcgccggcgacgccgcaatgttcgccgatgcggtggccgatacgctcgccgccctcggcatcgagcgcgttcatctcgtcggtcattcgatgggcggcgggatcgcgctctttctggcgcagcagcggccacagcttgccgcctcgctgaccctgatcgcctcggccgggctcggccccgagatcaacggcgcctttatcgacggctttgtaaaggttcagcggcgccgcgaggcgcaggacctgctcgcggtgctggtgcatgatccgtcgctgatcagccgcgcgatgatcgaggaaacgctgcgctacaagcggctcgacggggtcggggcggcgctcgatgcgatcgcgcgcgcctggttcgccgatggacgccagaggctcgatttgcggccggcgctcgccgcgctgccgatgccggtgcagctgatctgggggcgcgacgaccgcatcatcccgctcgcccatgccgaagcgctggccggccagctgccggtccatattctcgatgaggtcggccatctgccgcagatggagaaggcgggcgacgtcaatcggctgatcgcccgctttgtcgcagcgcatccgtag

SEQ ID NO: 880 - protein, 312 aa, Unknown
  Obtained from environmental sample
  DOMAIN (98)...(306): alpha/beta hydrolase fold
MTLPVGALLAVAAPASVADAEIDAFVAAFVAPEAAPEDAAEAESAFAPRDIEAGGRRLRVLDLGGEAGRGGPPLVLVHGFGADLNAWMFNQPALAASRRTVALELPGHGGSDKQVGAGDAAMFADAVADTLAALGIERVHLVGHSMGGGIALFLAQQRPQLAASLTLIASAGLGPEINGAFIDGFVKVQRRREAQDLLAVLVHDPSLISRAMIEETLRYKRLDGVGAALDAIARAWFADGRQRLDLRPALAALPMPVQLIWGRDDRIIPLAHAEALAGQLPVHILDEVGHLPQMEKAGDVNRLIARFVAAHP

SEQ ID NO: 881 - DNA, 963 bp, Unknown
  Obtained from environmental sample
gtgattactttgataaaaaaatgtttattagtattgacgatgactctattatcaggggttttcgtaccactgcagccatcatatgctactgaaaattatccaaatgattttaaactgttgcaacataatgtatttttattgcctgaatcagtttcttattggggtcaggacgaacgtgcagattatatgagtaatgcagattactttaagggacatgatactctgcttttaaatgagctttttgacaatggaaattcgaacgtgctgctaatgaacttatccaaggaatatacatatcaaacgccagtgcttggccgttcgatgagtggatgggatgaaactagaggaagctattctaattttgtacccgaagatggtggtgtagcaattatcagtaaatggccaatcgtggagaaaatacagcatgtttacgcgaatggttgcggtgcagactattatgcaaataaaggatttgtttatgcaaaagtacaaaaaggggataaattctatcatcttatcagcactcatgctcaagccgaagataccgggtgtgatcagggtgaaggagcagaaattcgtcattcacagtttcaagaaatcaacgactttattaaaaataaaaacattccgaaagatgaagtggtatttattggtggtgactttaatgtgatgaagagtgacacaacagagtacaatagcatgttatcaacattaaatgtcaatgcgcctaccgaatatttagggcataactctacttgggacccagaaacgaacagcattacaggttacaattaccctgattatgcgccacagcatttagattatatttttgtggaaaaagatcataaacaaccaagttcatgggtaaatgaaacgattactccgaagtctccaacttggaaggcaatctatgagtataatgattattccgatcactatcctgttaaagcatacgtaaaataa

SEQ ID NO: 882 - protein, 320 aa, Unknown
  Obtained from environmental sample
  SIGNAL (1)...(29)
  DOMAIN (37)...(319): Endonuclease/Exonuclease/phosphatase family
MITLIKKCLLVLTMTLLSGVFVPLQPSYATENYPNDFKLLQHNVFLLPESVSYWGQDERADYMSNADYFKGHDTLLLNELFDNGNSNVLLMNLSKEYTYQTPVLGRSMSGWDETRGSYSNFVPEDGGVAIISKWPIVEKIQHVYANGCGADYYANKGFVYAKVQKGDKFYHLISTHAQAEDTGCDQGEGAEIRHSQFQEINDFIKNKNIPKDEVVFIGGDFNVMKSDTTEYNSMLSTLNVNAPTEYLGHNSTWDPETNSITGYNYPDYAPQHLDYIFVEKDHKQPSSWVNETITPKSPTWKAIYEYNDYSDHYPVKAYVK

SEQ ID NO: 883 - DNA, 918 bp, Unknown
  Obtained from environmental sample
atgcaggctcaacaccttgcgggcaacggccgtccgaccgatgcacagtggctgctggcagaccccgatcaccagatgccattgccctttccccaggccgaggcctatgcgcgccaggtcatggccctggcccgggaactgccgaccgacggactcgacgtgcgccttggcgtcccctacggccggcacccgctgcaccgctacgacgttttcggtccgaaaaatgcccaggacgcaccagttctggtcttctggcatggcggtggctggaccaacggctaccgcggctacgtcagcttcatggcgccgctggtggcggagctgggctgcatcctgatcgccccctcctaccggcttgcgccacgggacaggctgcctgcggcctacgaagacgggcttgccgcgctgcgccatgtgttcgacaacgcaccgtccttcggcggctgcgtccatcgcctccacctcgctgggcactccgccggcggccatcttgcggccctggtcgccctgcggcatgccgacatccggcaggcaggcatcccggctggcgccatccgtgcctgcctgcccatcagcggcatcatggacctgcaccatccggccccagaggaaggcagcctggagcagcgtgtctacaccatggtgctgagcgagcccggcgacgatgtggtcatgagcccggtccactggagcatgggcagcaccgttcccatgcacctgagctacggcgagcgggacagcgaacgcgtgcagcgctccaaccaggagcttgcgcacaggctgtcgcaagccggcacgccatgctcgctttccgttgaagcaggcctggaccacttctccacccataccaccttgcgcgcaccccaggcctcctggtaccagcgcctggcacgcatcctggaggcatccgcaccatga

SEQ ID NO: 884 - protein, 305 aa, Unknown
  Obtained from environmental sample
MQAQHLAGNGRPTDAQWLLADPDHQMPLPFPQAEAYARQVMALARELPTDGLDVRLGVPYGRHPLHRYDVFGPKNAQDAPVLVFWHGGGWTNGYRGYVSFMAPLVAELGCILIAPSYRLAPRDRLPAAYEDGLAALRHVFDNAPSFGGCVHRLHLAGHSAGGHLAALVALRHADIRQAGIPAGAIRACLPISGIMDLHHPAPEEGSLEQRVYTMVLSEPGDDVVMSPVHWSMGSTVPMHLSYGERDSERVQRSNQELAHRLSQAGTPCSLSVEAGLDHFSTHTTLRAPQASWYQRLARILEASAP

SEQ ID NO: 885 - DNA, 606 bp, Unknown
  Obtained from environmental sample
atgcgaatgtggttgttgagtgccggcctggccttgatgtgcatgacccagggggcagccgcaggtactgtactggtcgtcggcgatagtatcagtgccgctttcggcctggatacccgccagggctgggtcgccttgctggaacagcgcctgaaaagcgagggtttcgacgccagggtggtcaacgcctcgatcagcggcgacaccagtgccggaggccaggcgcggctgccggcgctgcttgcagagcacaagccggagctggtggtgctggagctgggaggcaatgacggcctgcgtgggcagccgccaaagcaattgcaacaaaatcttgcctcgatgatcgaccgctcccgtgaggccggggccaaggtgctgttgctgggcatgcgcttgccgcccaactacggcaagcgttacaccgacgccttcgcaaaggtctatgccgacctgcaggccgagaaacaggtggcgctggtgccgtttttcctcgaaggggtagggggtgtgcccgagctgatgcaggccgatggcattcatccgggggcgggcgcccagcaaaggttgctggaaaatgcctggccgcaactaaaaccgctgctttga

SEQ ID NO: 886 - protein, 201 aa, Unknown
  Obtained from environmental sample
  SIGNAL (1)...(21)
  DOMAIN (24)...(193): GDSL-like Lipase/Acylhydrolase
MRMWLLSAGLALMCMTQGAAAGTVLVVGDSISAAFGLDTRQGWVALLEQRLKSEGFDARVVNASISGDTSAGGQARLPALLAEHKPELVVLELGGNDGLRGQPPKQLQQNLASMIDRSREAGAKVLLLGMRLPPNYGKRYTDAFAKVYADLQAEKQVALVPFFLEGVGGVPELMQADGIHPGAGAQQRLLENAWPQLKPLL

SEQ ID NO: 887 - DNA, 726 bp, Unknown
  Obtained from environmental sample
atgctcgcgctgatccggaaggagtggcgcctgaaccgggcgatcgtcatcgggtgcctggtcacgatggtgatgccgtacgtcatcaacgtcgccaatacgtggatcaacccgtctcgcggcgcaaacctcgagccgcgcgattacgtggacgcggtgaagttcgcagcgtacgcgtgcctggcgatcacggtcgccttcgccgccgcgttcggcggactcgcgttcgccggcgagcggcgcgagcggacggcggagttcatggcgatgttgccggtctcgcgcgacgcgatcatcgcgagcaagctcgtcgtgcccgccgcctgcctcgcgacgttgatcggcgtgcacgtgctcgtgctgctcgcgtgcggcgagtgggccgtccgcatcggcctgcggcggcaggacgcgcaggacgccttgtacgcggcgatgttcgccgtcgcctacgccgtcgccgtcttcggcatcgcctgggcgctgtcggtgttcctgcgtagcgcggcgatcgccggcaccatcacgattgccatcggcgtggggatgctcttcgggatgatggcctggggcgaccgggtgcaccggttccttcacgagcggaactacgtccggtccgacagcgaattcgggacgatcttcatcatctgcgggacggtcgggctgatcgggctcgtcgcgatcgccgcctcgagccttcactaccgccggcgcgtcgcgccgtag

SEQ ID NO: 888 - protein, 241 aa, Unknown
  Obtained from environmental sample
MLALIRKEWRLNRAIVIGCLVTMVMPYVINVANTWINPSRGANLEPRDYVDAVKFAAYACLAITVAFAAAFGGLAFAGERRERTAEFMAMLPVSRDAIIASKLVVPAACLATLIGVHVLVLLACGEWAVRIGLRRQDAQDALYAAMFAVAYAVAVFGIAWALSVFLRSAAIAGTITIAIGVGMLFGMMAWGDRVHRFLHERNYVRSDSEFGTIFIICGTVGLIGLVAIAASSLHYRRRVAP

SEQ ID NO: 889 - DNA, 1581 bp, Unknown
  Obtained from environmental sample
atgaacgctgcgcaactgctttccgcgataacgggttccgtcacggtgttggctttactcgcacaggcacccgcgcgagcgcaggtgcaaacgcctgcgccaacgcagcaggcaacctgcagcgcgctcgccgagtgggccggcggtccgggcgacttgcgaattgtcgaagcgcgcttctataccgaacgcagtgtcggcggtcccggcggcggccagacgctaccgccgcattgccacgtcaccggcagcttcgagcatcgcaccggcatcggtgacgtcgagtatgcgatcggtttcgcaatcaacctgcccgaagactggaacggccgctttctgtttcagggcggcggagggctgaatggcgtggtcagagaaccggtcggcgccggggctagcggcggccgctccgcgctcgcgcgcgggttcgcagtcgtcagcacggacagcgggcacaccggttccggcttcgacagcagcttcatggccgaccaactcgcgctgctgaacttccagtttctggcaaacgcgaagaccaccgaggtggcgcgcccgatcgtcgaggcctattacggctcggcgcctcatcacagctatttcgtcggctgctccaccggcgggcgcgaaggcatgatcatggcgcagcgctatcctcaccttttcgacggcatcgtctccggtgcgccggcgatgcgaacgacgatcagcaatctggcattgcgctggatcagcaaccagtacgtcagggccggcgtatcaaatccgcgcgagccgttcgccgccgaagagcgggccctgatcatgggcgcgctgatggattcatgtgatgcactggacggccttgaggatagcctgatcttcaatcgcacgtcctgcgacttcgacccgcgcgcgctcgcgtgctccgcgaatcccggcagaacccccgggcaacagtgcctggtcgatgccaaggccgaagctctggcgcgcgccatggcaggcccggtcaatgcagccggcatgccggtctacgtctcgtttccttacgactcgggcatcgacgataccgggggtctgccggggctcctgatcgcgggcggcagcccgccggtcggcgggagcggcgcagacatgtccagccaggacgtcgacgcggaattcatggctgcactcgtggcaaatgaggcgctcggcgccaccgcctggcagttcaacgtgagcacgttcattgaggcagggggcaagcagatgttctatcacggcgaggccgacccgtggttttccgcgaacgacaccgtgcgttacttcgatgcaatgagtgccgccaacaatgacgtcgcagccgttgatcaatacagtcgcctgtacctcgtgcccggcatggcccactgcgccggaggcgagcagaccgtcgactcattcgatctgctgacaccgatcgtcgagtgggtcgagaacggcaacgccccgggtgccgtgacagccaccggcgcctcgatgcccggccaaagccggccactgtgcccgtacccgagctacgcgcacttcgagggcggcgaggcagcgaacgtcggcgattacgcgtgccgcatgccgtag

SEQ ID NO: 890 - protein, 526 aa, Unknown
  Obtained from environmental sample
  SIGNAL (1)...(27)
MNAAQLLSAITGSVTVLALLAQAPARAQVQTPAPTQQATCSALAEWAGGPGDLRIVEARFYTERSVGGPGGGQTLPPHCHVTGSFEHRTGIGDVEYAIGFAINLPEDWNGRFLFQGGGGLNGVVREPVGAGASGGRSALARGFAVVSTDSGHTGSGFDSSFMADQLALLNFQFLANAKTTEVARPIVEAYYGSAPHHSYFVGCSTGGREGMIMAQRYPHLFDGIVSGAPAMRTTISNLALRWISNQYVRAGVSNPREPFAAEERALIMGALMDSCDALDGLEDSLIFNRTSCDFDPRALACSANPGRTPGQQCLVDAKAEALARAMAGPVNAAGMPVYVSFPYDSGIDDTGGLPGLLIAGGSPPVGGSGADMSSQDVDAEFMAALVANEALGATAWQFNVSTFIEAGGKQMFYHGEADPWFSANDTVRYFDAMSAANNDVAAVDQYSRLYLVPGMAHCAGGEQTVDSFDLLTPIVEWVENGNAPGAVTATGASMPGQSRPLCPYPSYAHFEGGEAANVGDYACRMP

SEQ ID NO: 891 - DNA, 756 bp, Unknown
  Obtained from environmental sample
atgttcaaaacagcaacgctactcgcaagattagcatacaagtcagataacagaataaaacaagagattgaggctaacaacctctctcttgttacaataaaagaagttgataacacagcaagttttctaaacgacccaagacagaaggatttaaagttctacatagcagatgacaatgaagaaggtataaggtacttcgtcatacgcggctctgtgggattattagagaattgggtacacaacctagcattctggaaaaatacagacgatatacattggggatttagcaaagaggctgagtcattattacctcatatggagcagtacgtaaatctaggatataaacagataactataggtcattctaaaggagctgccttaggtcatatattagctccagacttaaaagcagatatttcaataggcataggaagtccgttctttgctggacgtaaatacatagaaagtttaaaaaataaatggaatacaacttactacgacattgttcaccacctagatatagtttcacttttaactagaaaaatattccaacctctaggaactgtgttgtatattgatcgtaaaaataatctagtagaaaatccaaccagaatgaaaagaattagaaacaccacactgtcgtttatacttaagagatacagagatggaagaacgttacacgatattcttcactaccactgctataaaaggtacgaagatttctttaagatagatcaccgaaaagctaaaaagtga

SEQ ID NO: 892 - protein, 251 aa, Unknown
  Obtained from environmental sample
  DOMAIN (63)...(183): Lipase (class 3)
MFKTATLLARLAYKSDNRIKQEIEANNLSLVTIKEVDNTASFLNDPRQKDLKFYIADDNEEGIRYFVIRGSVGLLENWVHNLAFWKNTDDIHWGFSKEAESLLPHMEQYVNLGYKQITIGHSKGAALGHILAPDLKADISIGIGSPFFAGRKYIESLKNKWNTTYYDIVHHLDIVSLLTRKIFQPLGTVLYIDRKNNLVENPTRMKRIRNTTLSFILKRYRDGRTLHDILHYHCYKRYEDFFKIDHRKAKK

SEQ ID NO: 893 - DNA, 1083 bp, Unknown
  Obtained from environmental sample
atgacatcgaagcaatccatcaactcctccctgatcctggggggcggcatcggtctcggcgcctttcaggtgggcgccttcgaggttctgcaagcggccggaataaatatccgctcagtctcgggggcatccatcggagcgatcaatggcgcgattatcgtcggcaatgcgcccgaagatcgagcggccaagcttcgagggttctgggacgtgatttcagtggaagcgctgccgacggcgtggcttgacccttggggggtcggcagcaggggccggtcgcggcgtctgcggaactgggtgaactcgcttgccaccggggtcacgggaagcccaggcctcttcctcccgcgcctggcttcaggtggccgcgggcacgcgcgtagtctctacgataacagcgtggccgcgcgtactttatcctccttcgtcgatttcgaccgcctcaatgacggcagcgttcggttctgccttgcgaccaccgacgtcgaggccggagaggccgcgttcttcgacactgcgaagggcgatcgcatcgagctcgatcacctgctcgccagcagctcgctgctccccgctttcgaacccgtccgtatcggcaagcggctgctggccgacggaggccttgcggttaatgttcctcttgaagcggaaatcggccctgcacgagggagctgcgccgagccgctgtgctttgtcctcgacctctacacgccaggaggcggccagcctttgccgctcaatcgcgtggtggaaagctcactggacctgatcttcggaatgcagacgcggatgcggctggcagggctggcgcgggagtgggagctgagatcaaagctccgagcggcaacagcttccccggaagccgatggcggctatgcgtgcggcggcgtggaccttttctacatgagctatcgcggagcggaagaagacgccggtttcggaaagccctttgacttgtcccctgcaaccctgaccgaaaggatcgaggaaggacggagggcagcggaccgcgcgctggcgcttcgaaacacgctgcctgccgagacccatgccgatcttagagttcatagggtcgcccactga

SEQ ID NO: 894 - protein, 360 aa, Unknown
  Obtained from environmental sample
  SIGNAL (1)...(26)
  DOMAIN (11)...(218): Patatin-like phospholipase
MTSKQSINSSLILGGGIGLGAFQVGAFEVLQAAGINIRSVSGASIGAINGAIIVGNAPEDRAAKLRGFWDVISVEALPTAWLDPWGVGSRGRSRRLRNWVNSLATGVTGSPGLFLPRLASGGRGHARSLYDNSVAARTLSSFVDFDRLNDGSVRFCLATTDVEAGEAAFFDTAKGDRIELDHLLASSSLLPAFEPVRIGKRLLADGGLAVNVPLEAEIGPARGSCAEPLCFVLDLYTPGGGQPLPLNRVVESSLDLIFGMQTRMRLAGLAREWELRSKLRAATASPEADGGYACGGVDLFYMSYRGAEEDAGFGKPFDLSPATLTERIEEGRRAADRALALRNTLPAETHADLRVHRVAH

SEQ ID NO: 895 - DNA, 1533 bp, Unknown
  Obtained from environmental sample
atggcacacaaaattgaacctccgttctatccgatcgtgtacgtccgcggttacgccatgacggcgaacgaacgcgaagaaacatttaacgacacctactacggattcgccgccacctccgtggagaaacgggacgtgccgccgccggattattttcgcgcggacatgttcgagggacagttgatccgtttcatgaagatgcgcgagcacgcctattacgacgcgacgaatcgtggtttggaagattgtccggacaatcccgtgcgcagtctctgggtctgccgcttctacgaccaggacgttttcaaggacaagctgcgcagcattgaagatcacgcggaggaacttcgcgcgctcgtctgcgaaaccattcctgcccgcctcaaagcctgcaaggttgacctgggggcgaacctgaagaattacaaggtcattctcatcgcgcattccatgggcggtctggtctgccggacgttgattcagaatctgctgccccggcggaaggaaaatcccaaggactgggtgcatcgcttcatcaccattggcacgccccacaagggaatcgagctggggcgcatcccggatttcatggagcgatttgtcctgcgaacggcaaatccgttcgacgccaatatcttcgacgaaaagcggatgcggcaatacttgaaattgccttccgattacgagccgcacagcctcggacccagcgacgccccctacgcgtttcccgtaaaacgctgtctctgtctgatcggcagcgattacgaatcctatggtgccgcgcaacacctgaccggaagcttcagcgatgggctggtgaaacaggatcgggcttatgtcgtggccggcaaaccggacgccaaaggcaaatatgcgtcggaacaaaaatcctactgggccaacgtgcaccgcgctcattccggacggcggggaattgtaaacagctatgaaagtttcgaaaatgttcaccggtttattttcggcgatgtcagagccgagatttacctggagaacgttcagctcggagggacgccagtcgaaaatgccgattacttctacgacattgaatttgcgctctcgattcgcggcacgccggtttacctgcatcgccggcagcagactccctgtgaaaacgccatccgttactcgcgcagcgagcttcaggaaaagacggtccggctgcacacgcttttcctgaactcgggtttgaagctcaatccggatccgccttattcgcatttcaaattggaattccgggtccgcgaacatgcgatcaagaagggattgttttgggaccgggagtatccggagaagaccatttactcggaagatctcgaggtgcggattggcgattttgacgagaagcttcccggaaaagaggttcagtttcggtggctttcagagagtggcgactggcaggacgcactacacgatgcgaacgaattcagaatcaccttgcgcgccgccggttcgatgaccggaaactttctgattcgggccagcgcgtggccggatgccgccgtggctgattag

SEQ ID NO: 896 - protein, 510 aa, Unknown
  Obtained from environmental sample
MAHKIEPPFYPIVYVRGYAMTANEREETFNDTYYGFAATSVEKRDVPPPDYFRADMFEGQLIRFMKMREHAYYDATNRGLEDCPDNPVRSLWVCRFYDQDVFKDKLRSIEDHAEELRALVCETIPARLKACKVDLGANLKNYKVILIAHSMGGLVCRTLIQNLLPRRKENPKDWVHRFITIGTPHKGIELGRIPDFMERFVLRTANPFDANIFDEKRMRQYLKLPSDYEPHSLGPSDAPYAFPVKRCLCLIGSDYESYGAAQHLTGSFSDGLVKQDRAYVVAGKPDAKGKYASEQKSYWANVHRAHSGRRGIVNSYESFENVHRFIFGDVRAEIYLENVQLGGTPVENADYFYDIEFALSIRGTPVYLHRRQQTPCENAIRYSRSELQEKTVRLHTLFLNSGLKLNPDPPYSHFKLEFRVREHAIKKGLFWDREYPEKTIYSEDLEVRIGDFDEKLPGKEVQFRWLSESGDWQDALHDANEFRITLRAAGSMTGNFLIRASAWPDAAVAD

SEQ ID NO: 897 - DNA, 1506 bp, Unknown
  Obtained from environmental sample
atggaaaatccctccgcccctgtggttgaaacgcgccagggcgcactgattggttttactgaaggcgatacccacgtgtggtgcggcattccctatgcagcaccgcccgtaggccagtggcgctggcgctccccgcgtcctcccgcgcgctgggatggcgtacgtccggcgacggcgttctccgcctccagctggcagagcagcgaaagctgtcaggagctgggtggcggcgatcccggccagttctctgaagactgcctgtaccttaacgtctggtcgccagtcgcacgcgccgatccgcttccggtgatggtctggctgcacggcggaggatttaccctcggcgctggcgggctgcctccgtataacggcagggcgctggcgaagcgcggcacggtggtggtgacgatcaattaccgtctcggacacctcggcttttttgcccatccggcgctggagggggaagaagagcgcgtggtgcataactttgcgctgctcgatcagatccaggccctggaatgggtgcgcgataacatcgccgcgttcggcggcgatcctgagaacatcaccgtatttggcgagtcggccggcgcgcgcagcgtgctgtcgctgatggcctctccgcttgcgcgaggactgttccataaagccattgtgcaaagcgggtacacgctgccggacacgccacgcgagcaggccatgcataaaggcgaagcgattgccgcccatttcggcctgcaaaatgccaccgctgaacagcttcgcgcgatcccgcctgaggcgttctggccgctgacctcgccgctgaatatcgcccctgcgcccatcgtgggggattgcgttttgcctgaggccatgctcgacgttttcttcgcggcccgccagcatcctgtaccggtgatgattgggtcaaacagcgacgaagccagcgtgatgtcggtgttcggggtcgatctggccgggcagatccagaagcttcgccgcgagcggcgctttggcctggggctgattaagctgctttatcctggcgtgaagggcgatgaggaacttggcaggcaggtatgccgcgacatggccttcaccactatgggatacgtggtgatgcaggcgcagcagcgggcgggcggcctgtgctggcgatactggtttgattatgtggccgaagcggagcacgcgacgtacatcaacggcgcctggcacggcaacgaagtgccctacgtgttcgatacccttggacaggtggaaccctcgcggcagtatgtaaatgaacgcgatctggccttcgccgctcaggtggcggactactgggtgagcttcgcccgggatgcgggggcacgcgatagtctggcagggcccacgcgctggcccgcctgccggaaagggcgagacgtgctgttaagtatcggtgtgaataaacatgcaggttttcggcttgaaaaccgcttcatgcgtgcccgaatgagcctcttcaaacgggtgatgaaacaccacgtcagcctcgactga

SEQ ID NO: 898 - protein, 501 aa, Unknown
  Obtained from environmental sample
  DOMAIN (1)...(481): Carboxylesterase
MENPSAPVVETRQGALIGFTEGDTHVWCGIPYAAPPVGQWRWRSPRPPARWDGVRPATAFSASSWQSSESCQELGGGDPGQFSEDCLYLNVWSPVARADPLPVMVWLHGGGFTLGAGGLPPYNGRALAKRGTVVVTINYRLGHLGFFAHPALEGEEERVVHNFALLDQIQALEWVRDNIAAFGGDPENITVFGESAGARSVLSLMASPLARGLFHKAIVQSGYTLPDTPREQAMHKGEAIAAHFGLQNATAEQLRAIPPEAFWPLTSPLNIAPAPIVGDCVLPEAMLDVFFAARQHPVPVMIGSNSDEASVMSVFGVDLAGQIQKLRRERRFGLGLIKLLYPGVKGDEELGRQVCRDMAFTTMGYVVMQAQQRAGGLCWRYWFDYVAEAEHATYINGAWHGNEVPYVFDTLGQVEPSRQYVNERDLAFAAQVADYWVSFARDAGARDSLAGPTRWPACRKGRDVLLSIGVNKHAGFRLENRFMRARMSLFKRVMKHHVSLD

SEQ ID NO: 899 - DNA, 936 bp, Unknown
  Obtained from environmental sample
gtgccggtcgacccgcacatcgcagcgatgctcaccatgatggaacaggcgggcctgccgcccatgtacgaggggagccccgaggcggggcgcgccctgtacctgcagctcacccacggcgcccggaccccggagcagctcgtccccgtggcgggcaccgaggaccgcaccgtccccggcggccagggggagctccgggcgcgggtctaccggcccgagggcgaggggcccttcccgaccgtcgtcttcttccacggcggcggctgggtgatcggcgacctggacacccacgacaacatggcccgcaacgtctgccgcggcagccgcgcggtcgttgtcgcggtggactaccggctggcgcccgagcacccgttccccgctgcggccgaggacgcggtggccgcggcccgctgggtggcccagcacctggacgagctgggcggggacgaccggctcgcggtcgccggggacagcgccggcggcaacctcgccgcggtggtggcccagcagctcaccgccgacggcaccccgctgaccgggcagttcctcatctaccccgccgtcgacgccgagggcgagtacccctcccgcgtggagaacgcgaagggttacttcctcgagaaggacaccatggactggttctacggccactacgccggcgcctgggaggacgcgaaggacgcccggttgtccccgctgcacggcgccgacctctccggcctgccgccggcggtcatcgccaccgccgagtacgacccgctgcgcgacgagggcgaggcctacggcgaggcgctggaggccgccggggtccatgccgacgtgcggcgctacgacggcctgatccacggcttcttcgacatggggacgatctcgcccgccgcccaggccgccatcgacgagagctgcgcgcgcttcggcgccctcatccggaagtga

SEQ ID NO: 900 - protein, 311 aa, Unknown
  Obtained from environmental sample
MPVDPHIAAMLTMMEQAGLPPMYEGSPEAGRALYLQLTHGARTPEQLVPVAGTEDRTVPGGQGELRARVYRPEGEGPFPTVVFFHGGGWVIGDLDTHDNMARNVCRGSRAVVVAVDYRLAPEHPFPAAAEDAVAAARWVAQHLDELGGDDRLAVAGDSAGGNLAAVVAQQLTADGTPLTGQFLIYPAVDAEGEYPSRVENAKGYFLEKDTMDWFYGHYAGAWEDAKDARLSPLHGADLSGLPPAVIATAEYDPLRDEGEAYGEALEAAGVHADVRRYDGLIHGFFDMGTISPAAQAAIDESCARFGALIRK

SEQ ID NO: 901 - DNA, 1020 bp, Unknown
  Obtained from environmental sample
atgactgaggccacgcaggctgtgcccgaaggcaaaggcgtgccgatcccgcacgctgatctgggggctcgaggagtgctcgacccccaggtggctgaagttctgcgcctgcatgccaaggcgggacaagccccgtacgagaccatcggagccaatgccgcgcgcaaggcttttgacaaggccagccgtgtgctcgagattggctcacgccccgtgcatcggattgatcatgtcgagattcccgggcgtgccgggccggtgcatggccggctgatctggccccatgaaccgagctgggtcgatcgacttcctgtgctgctgctgttgcacggcggcggtttcacggtgggctcttccgcgaccatcgaacacattgcgcgcatgctcgccatggaggtgcattgcgccatactggcgctggactaccgtctggcgcccgagcaccggtttccagccgccttcgaggatgcctgggatgcgctggtctggctgcatgaggaagcgggcgcactggggctcgacgcttcgcgcattgccgttggaggcgactcggccggggggaccctggcggccgcctgtgcattgcaggcccgcgacgcaggcttgccattgcgtctgcagtggctggtctacccggggaccggcgcgcaccaggacaccgcctctcacctgcgtctggctgaaggctacctcatcacacgcaagaccattctctggttctttgagcaatacctcgcccacccggcacaacgtgaagactggcgcttcgcccccttgctcgcaactgacctccgcggcctggcgccggcctggatagcggtggccgaattcgatccgctggtcgatgaaggcgtggcatatgcacggcgcatgcaacagtcgggggtggaagtccacctcgatttctatccgggcatggtgcatgcgttcttcaacatggggggctatgtcaccatggccaggcgcgcacatgcccagggtgtggcagcattgcgcgcagcattcacgattcagggctga

SEQ ID NO: 902 - protein, 339 aa, Unknown
  Obtained from environmental sample
MTEATQAVPEGKGVPIPHADLGARGVLDPQVAEVLRLHAKAGQAPYETIGANAARKAFDKASRVLEIGSRPVHRIDHVEIPGRAGPVHGRLIWPHEPSWVDRLPVLLLLHGGGFTVGSSATIEHIARMLAMEVHCAILALDYRLAPEHRFPAAFEDAWDALVWLHEEAGALGLDASRIAVGGDSAGGTLAAACALQARDAGLPLRLQWLVYPGTGAHQDTASHLRLAEGYLITRKTILWFFEQYLAHPAQREDWRFAPLLATDLRGLAPAWIAVAEFDPLVDEGVAYARRMQQSGVEVHLDFYPGMVHAFFNMGGYVTMARRAHAQGVAALRAAFTIQG

SEQ ID NO: 903 - DNA, 744 bp, Unknown
  Obtained from environmental sample
ttgaaaatcaaaaaacctgaaccctttacatttgaagcaggtccccgtgcagtattgttattacatggctttacgggacatactgctgatgttcgtatgttaggtcgttttttagagaaaaagggatatactagccatgcacccatttatcgtggacatggagaagagccggaatcactaatcaaaacaacaccagaagattggtggaatgatgcattatcggcatataatcatttaaaggatctaggatataaagaaatagcaattgccggactgtcattagggggagcatttgctcttaagttagcaagtaataatcaggtaaagggtgtcattccaatgtgttctcctatgtattttgataatacggaacaattaacacaaggatttcgtacctttgcgaaacaatataaacagtttgaaaaaaagaacacagaacaaattgatactgaaataaatgaattgatggagaattctgtaccaatgttcgatcatattcgtacgttctttcatgatgtgaaagatgtagttgatctaatttattcacctacaatggttgtgcaagcgagacaggatcaaatgatcaaccctgaaagtgctgaatttatttatgaacatattgcaacagatgagaaaaaaattaagtggtacgaagagtcgggacacgtcattactttagataaggaaagagatacgttatatgacgatatttatatgtttctagaatcacttaattgggaataa

SEQ ID NO: 904 - protein, 247 aa, Unknown
  Obtained from environmental sample
MKIKKPEPFTFEAGPRAVLLLHGFTGHTADVRMLGRFLEKKGYTSHAPIYRGHGEEPESLIKTTPEDWWNDALSAYNHLKDLGYKEIAIAGLSLGGAFALKLASNNQVKGVIPMCSPMYFDNTEQLTQGFRTFAKQYKQFEKKNTEQIDTEINELMENSVPMFDHIRTFFHDVKDVVDLIYSPTMVVQARQDQMINPESAEFIYEHIATDEKKIKWYEESGHVITLDKERDTLYDDIYMFLESLNWE

SEQ ID NO: 905 - DNA, 927 bp, Unknown
  Obtained from environmental sample
atgcccaaatacagaattcttagtttggacggcggcggaatccgggggctgctcagcgcgattctgctcgagcggttggaagcggaggcacccaattggctgagccaggtggacctgatcgccggcacatccaccggcgggatcatcgccctgggtctcgccaaaggcctcagcccaacccaactgcgcaatctctatcaactgcgcggggcggcgatattcgatgattcatggtgggacgacgtgctcgatattgggaagatttcgggcgcggattatgataacaagcaactcaccaaagagttgaagacgattctcggcaacacgaaactgcgcgagttgtcgaagcgggttttgatttcgagtttcgatctggacagtgaagagcgcgatcccaccaaacgaagttggacgccgaagttcttccacaacttcccgggcatcgacagcgacggcgagcaactggcctacaaggtggcgctgtacaccagtgccgcgccgacgtattttccgaccgtggacgggtacatcgatggcggtgtggtggccaacaaccccagcatggcagccctcgcgcaaacgcaggacacccgcgcgctgaaaacaccgccgcgcttctccgaaatccggctgctctcgatcggcacgggcaaatccctctatcgcatcgaagggcagaacctggactggggctacgcccagtgggccaagccgctcatcaacatcatgatggacggcgtgatgggtgtggcagattaccagtgccggcaggtcctggacgacaattattgccggatttcgcccaccttcccgcccggcgcggtgtttcccttggacggtgtcaaacagattcccgacctggtgacctttgccacttccgtggacctcacgcgcgccgttcagtggatcaagagcaagtgggcttag

SEQ ID NO: 906 - protein, 308 aa, Unknown
  Obtained from environmental sample
  DOMAIN (7)...(191): Patatin-like phospholipase
MPKYRILSLDGGGIRGLLSAILLERLEAEAPNWLSQVDLIAGTSTGGIIALGLAKGLSPTQLRNLYQLRGAAIFDDSWWDDVLDIGKISGADYDNKQLTKELKTILGNTKLRELSKRVLISSFDLDSEERDPTKRSWTPKFFHNFPGIDSDGEQLAYKVALYTSAAPTYFPTVDGYIDGGVVANNPSMAALAQTQDTRALKTPPRFSEIRLLSIGTGKSLYRIEGQNLDWGYAQWAKPLINIMMDGVMGVADYQCRQVLDDNYCRISPTFPPGAVFPLDGVKQIPDLVTFATSVDLTRAVQWIKSKWA

SEQ ID NO: 907 - DNA, 960 bp, Unknown
  Obtained from environmental sample
atgcgcgatggcaggaacttgaacgaattgctggagaatagaccgatggcaacttccttgcaaaaatgcattcacctgggcttctgcctgatagtcctgggcgcggccctgtccgcgcacgcaaagttcgagacccacacccgcgtacccttcgccgaacccgagggtgaaaccttgcgtctgaccctgtggacccccaacaacgccgagaccaagcggcccgggctggtgatgattcacggcggcggctgggccatgggaacgcgcaccatgatgcgctcttacggcgaagccttcgccgacgcgggctatgttgtggcctccatcagttaccgcatgatgcccaagtacgcgttcccgagccaactggaagacgccaaggcggcggtccgctggatgcgcctgaacgccggccaatacggcatcgaccctgaccggatcgcggtaatgggcagttcggcaggcggacaactcgccgcgcttgtcgcgacgacaacaccagaggacggtttcgagggcacggaaaatctggggccttccagcgacgtccaggcggccatcatcatctacggcgcggttgatctcaccgattgggaagaacgtgtcgaagaaagtaaaaacaaagggttctttcggcggaaactcggcggctttctcgaagatttcgtctcccgcgaccaaaaggatgtcgagaatcccttcgaggcggcgtctccggtgacctatgtggacgaaaacacggcgccgatgctgttcatacatggatcgaaggacggcatggtcagcatggatcaaccggacacgatggtccagcgcctcgccgaggcgggcgtgcccgtccgcttcctcgtggcggaagggcagcgccatggcttcgatcatttcagccctacgctacgcaagcgcatgatcgaggaaatgctcaagtttctcgatgaattcatgccggcggagcggtag

SEQ ID NO: 908 - protein, 319 aa, Unknown
  Obtained from environmental sample
  SIGNAL (1)...(41)
MRDGRNLNELLENRPMATSLQKCIHLGFCLIVLGAALSAHAKFETHTRVPFAEPEGETLRLTLWTPNNAETKRPGLVMIHGGGWAMGTRTMMRSYGEAFADAGYVVASISYRMMPKYAFPSQLEDAKAAVRWMRLNAGQYGIDPDRIAVMGSSAGGQLAALVATTTPEDGFEGTENLGPSSDVQAAIIIYGAVDLTDWEERVEESKNKGFFRRKLGGFLEDFVSRDQKDVENPFEAASPVTYVDENTAPMLFIHGSKDGMVSMDQPDTMVQRLAEAGVPVRFLVAEGQRHGFDHFSPTLRKRMIEEMLKFLDEFMPAER

SEQ ID NO: 909 - DNA, 1260 bp, Unknown; identical to SEQ ID NO: 55
  Obtained from environmental sample

SEQ ID NO: 910 - protein, 419 aa, Unknown; identical to SEQ ID NO: 56
  Obtained from environmental sample
  SIGNAL (1)...(26)

SEQ ID NO: 911 - DNA, 906 bp, Unknown
  Obtained from environmental sample
atgagcacggtcggggccgaggaggcacgcatccggttccgctccttcacggtcgacctccgcgatccagcgtcgctgccggcggtcggggaggtcaccgagctgagcgtcgacggcgccgagggcccccgccccgcccggctctaccggccgaccgacgctggtgccgacacgcggttgccactggtggtgttcttccacgggggcggcttcgtgatcggcgacctcgacacccacgagggccaggcacgccgggtgtgccgcgagctcggcgcgctcgtgctcagcgtcgactaccgcctcgcacccgagcatccctacccggccgcccgcgaggactgcctcgccgcgacccgctgggccgccgaccacgccgacgacctcggcgccgaccccgaccggctggtggtcgcgggagacagcgccggcggcaacctcgccgccgtggtcgcccaggactgccgcgacgggcagggcccggcactggccgcccagctcctgatctatccggccaccgacatgaccgatccgggcggggaggtctatccctcccgccaggagaacgccgagggctacttcctcaccggcgacgacatgcgctggttcgagagcagctatctcggcggtgcgacggccggggagcccggcaactccccgatccacggggacctgaccggtcttcccccggccgtggtcgtcaccgcggagttcgatccgctgcgcgacgagggcgaggcctacgcgcgggcgctcgagggggccggcgtgccggtcgtgtcgatccgcttcgacgggctcatccacggcttcttcgacatgggaccgatctcgcccgcgtgtgaccgggcggccgacgagacctgccgggccctgtcggacctgctgcagcccgcggcgtcgggatga

SEQ ID NO: 912 - protein, 301 aa, Unknown
  Obtained from environmental sample
MSTVGAEEARIRFRSFTVDLRDPASLPAVGEVTELSVDGAEGPRPARLYRPTDAGADTRLPLVVFFHGGGFVIGDLDTHEGQARRVCRELGALVLSVDYRLAPEHPYPAAREDCLAATRWAADHADDLGADPDRLVVAGDSAGGNLAAVVAQDCRDGQGPALAAQLLIYPATDMTDPGGEVYPSRQENAEGYFLTGDDMRWFESSYLGGATAGEPGNSPIHGDLTGLPPAVVVTAEFDPLRDEGEAYARALEGAGVPVVSIRFDGLIHGFFDMGPISPACDRAADETCRALSDLLQPAASG

SEQ ID NO: 913 - DNA, 885 bp, Unknown
  Obtained from environmental sample
atgaaaactggtcgaaccatactgatcgcgtttctgttgactgcgttctccattcagacgacctttgcccaaccgaactcggccagcgtcgaaattcagcccgatgtggtgtacggccataaagacggcctggccctgaccatggacgtttatcgccccaccaacgccaatggagcagccatcttgttcatggtaagcggcggctggtactcacgctggcaaccgcccgaacaaacgcagcccatgtttcagccttacttggatgctggctttaccatgatcgccgtctgccacggcagtagtcctcgatattccattcccgagatcgtaccggacgtccgccgggccgtgcggttcgtccgccagaacgccgagcgctggcaacttaaccccgagcgcctgggcgccatgggcatgagcgcaggggggcacttgtcattgatgctcggtacaaccggcgacgacgggtcgccaaactcggcagacgatttgaactcggtctccagccgcgtaaccgccgtcgtggccctggtgcctcccaccgacctgcgtgtcgcggtgtgggaggcccccgaatcgctgccagcgtatcgcaattttccggcgcttgatttgtcgctggaactggccgagcaacattcgcccctggtgcacgtcacctcagatgacgccccggcgctggtccttatgggaggtaaggacgacctggtaccggccagacacggcgagtggatcaaggaggccttcgagcgcgagggggtcgagcacaagctgattatcttccccgacgcaggacacgggctggagggcgagcagactcaagcgaccgttgtgcgcgaggccatcgagtggttcaatgctcacttgctgagtgattaccgatag

SEQ ID NO: 914 - protein, 294 aa, Unknown
  Obtained from environmental sample
  SIGNAL (1)...(23)
MKTGRTILIAFLLTAFSIQTTFAQPNSASVEIQPDVVYGHKDGLALTMDVYRPTNANGAAILFMVSGGWYSRWQPPEQTQPMFQPYLDAGFTMIAVCHGSSPRYSIPEIVPDVRRAVRFVRQNAERWQLNPERLGAMGMSAGGHLSLMLGTTGDDGSPNSADDLNSVSSRVTAVVALVPPTDLRVAVWEAPESLPAYRNFPALDLSLELAEQHSPLVHVTSDDAPALVLMGGKDDLVPARHGEWIKEAFEREGVEHKLIIFPDAGHGLEGEQTQATVVREAIEWFNAHLLSDYR

SEQ ID NO: 915 - DNA, 627 bp, Unknown
  Obtained from environmental sample
atgatcgcggttgatttacccggccatggacgatcaccggcgagcgagtccatttcgattgccgactatgctctgcacgtgatttcgctgcaccaggctctcggcttaccaccagcacttgtcgtcggtcattcaatgggtggcgccatcgcattgcagatcgcgttgaccgcgccgcacatagtggccgggctgggattggtgagcaccgcagcccgtttacgtgtcgctccggcgctactcaccgggctggccggtgatctcgcggcgcgccgtgaagcgatcacaacgctggtcaactggttattcagcccaacagcaagccccgacctgatcaccgatgccctggccgaatataccgcgctcgatccggaactcttactggccgatctccgcgcctgtgacggttttgatctccgttcacgactggccgaaattcgttgtccggcactggtgatcaccggaactgatgatcgactgacgccgccaaaactcggcgccgagctggcggctgggcttggtgttccccaccatctcctgaccgatgttggtcatatgccgatgttggaagcacctgaccgcctgtccgatcagcttttacacctgctgcttgcctgcaataagtag

SEQ ID NO: 916 - protein, 208 aa, Unknown
  Obtained from environmental sample
  DOMAIN (2)...(201): alpha/beta hydrolase fold
MIAVDLPGHGRSPASESISIADYALHVISLHQALGLPPALVVGHSMGGAIALQIALTAPHIVAGLGLVSTAARLRVAPALLTGLAGDLAARREAITTLVNWLFSPTASPDLITDALAEYTALDPELLLADLRACDGFDLRSRLAEIRCPALVITGTDDRLTPPKLGAELAAGLGVPHHLLTDVGHMPMLEAPDRLSDQLLHLLLACNK

SEQ ID NO: 917 - DNA, 786 bp, Unknown
  Obtained from environmental sample
atgcgcgcacaggcaatcgactgcgacggtactgccgccgagtggatcacgctgcccgaatcgcgcgccgaaaaagtcattttctatatccacggcggcgcctggatgttcaagttcccgcgcctgcaccatgccatggtcgcgaagtggtgccgccgtctggatgcgcgcgccctgatggtcgattatcgcctggcgcctgaacacccgttcccaggcggtctcgacgatgtctggtcagcctggcaatggctgctcaccgaaggcatttcgccgcagagtgtcatcgtcgccggcgactcggcagggggcaatctgaccctggcgctgctgcaccggatcaaggccgccggcggggtgatgccggcgtgcgccgtcatgctctcgcccttcgttgatttcaccctgagtagtccgagcatggtaaccaacgaaaaacgtgacccgatgttcagcgtggcggcaatggtcggcctgcgccgccattacctcgcccccgaaaacatgctcagcgcctatgcatcgccactgttcgccgatttcagcggcctgccgccgctgttcttccaggccagcgccagcgaaatgctgcgcgacgactcactgcgcgccgcagcggcagcgcatgacgccggcgttcccgtcgaggtcgaactgtgggacaaggtgccgcacgtctttcaggcgttccaggaactctcgcattcggcggcggcgctagaaacgatcgctgattttgtcgagcgccatgcgaactggatgatgcctggatcaggcgccggctga

SEQ ID NO: 918 - protein, 261 aa, Unknown
  Obtained from environmental sample
MRAQAIDCDGTAAEWITLPESRAEKVIFYIHGGAWMFKFPRLHHAMVAKWCRRLDARALMVDYRLAPEHPFPGGLDDVWSAWQWLLTEGISPQSVIVAGDSAGGNLTLALLHRIKAAGGVMPACAVMLSPFVDFTLSSPSMVTNEKRDPMFSVAAMVGLRRHYLAPENMLSAYASPLFADFSGLPPLFFQASASEMLRDDSLRAAAAAHDAGVPVEVELWDKVPHVFQAFQELSHSAAALETIADFVERHANWMMPGSGAG

SEQ ID NO: 919 - DNA, 762 bp, Unknown
  Obtained from environmental sample
atgggctgcctgtcgttcctggtgctgccactgggatggttgctgccggcccgatggtttcggtgtaccacggaggcgcggctggatcaaggattggtgattgtgcttccgggagtggaaggccgcggttttttgagcttttcgattctgacgggtttggtggatgccggcgtgccgtatgccgtagaggtcatcgactggaccacgggctggaagccgttggcgttgtatcacctgcgggcctggcggcgaaatcaacgggtggcgcggcagattgcagagcgaattgtctgctatcaacgcgactttcccaaccggcccgtgtggatcatcggtcattccggcggcggtggcatggcgttgctcaccgcggcggcgttgccggaagccatgcgcgttaccggcatcgtgctgctcgcacccgccgtgtcaccccaattcgatgtcgccagcgcgctgggcaaggttgagcagggcatctggaaccactattcttggctggactggttctttgtgggactgggaacttcggtgttcggatgcttcgacggtcgccacggaccggctgccggcatggtgggatttcgactgcgcacggaactcatcgcatcgcaccacgcatcaacttcgaaggccgtcatcgagcaaacatgctactcctggcggatgctgcggcaattccatactggtggtcatttcggttgcgcccaccgggtgtttgtagcggagagtatcgctcctttgatgttgcccccgcggtga

SEQ ID NO: 920 - protein, 253 aa, Unknown
  Obtained from environmental sample
MGCLSFLVLPLGWLLPARWFRCTTEARLDQGLVIVLPGVEGRGFLSFSILTGLVDAGVPYAVEVIDWTTGWKPLALYHLRAWRRNQRVARQIAERIVCYQRDFPNRPVWIIGHSGGGGMALLTAAALPEAMRVTGIVLLAPAVSPQFDVASALGKVEQGIWNHYSWLDWFFVGLGTSVFGCFDGRHGPAAGMVGFRLRTELIASHHASTSKAVIEQTCYSWRMLRQFHTGGHFGCAHRVFVAESIAPLMLPPR

SEQ ID NO: 921 - DNA, 1038 bp, Unknown
  Obtained from environmental sample
atgacaacacaatttagaaacttgatatttgaaggcggcggtgtaaaaggtgttgcttacattggcgccatgcagattcttgaaaatcgtggcgtgttgcaagatattcgccgagtcggagggtgcagtgcgggtgcgattaacgcgctgatttttgcgctaggttacacggtccgtgaacaaaaagagatcttacaagccaccgattttaaccagtttatggataactcttggggggttattcgtgatattcgcaggcttgctcgagactttggctggaataagggtgatttctttagtagctggataggtgatttgattcatcgtcgtttggggaatcgccgagcgacgttcaaagatctgcaaaaggccaagcttcctgatctttatgtcatcggtactaatctgtctacagggtttgcagaggtgttttctgccgaaagacaccccgatatggagctggcgacagcggtgcgtatctccatgtcgataccgctgttctttgcggccgtgcgtcacggtgatcgacaagatgtgtatgtcgatgggggtgttcaacttaactatccgattaaactgtttgatcgggagcgttacattgatttggccaaagatcccggtgccgttcggcgaacgggttattacaacaaagaaaacgctcgctttcagcttgatcggccgggccatagcccctatgtttacaatcgccagaccttgggtttgcgactggatagtcgcgaggagatagggctctttcgttatgacgaacccctcaagggcaaacccattaagtccttcactgactacgctcgacaacttttcggtgcgttgatgaatgcacaggaaaagattcatctacatggcgatgattggcaacgcacgatctatatcgatacattggatgtgggtacgacggacttcaatctttctgatgcaactaagcaagcactgattgagcaaggaattaacggcaccgaaaattatttcgagtggtttgataatccgttagagaagcctgtgaatagagtggagtcatag

SEQ ID NO: 922 - protein, 345 aa, Unknown
  Obtained from environmental sample
  DOMAIN (8)...(195): Patatin-like phospholipase
MTTQFRNLIFEGGGVKGVAYIGAMQILENRGVLQDIRRVGGCSAGAINALIFALGYTVREQKEILQATDFNQFMDNSWGVIRDIRRLARDFGWNKGDFFSSWIGDLIHRRLGNRRATFKDLQKAKLPDLYVIGTNLSTGFAEVFSAERHPDMELATAVRISMSIPLFFAAVRHGDRQDVYVDGGVQLNYPIKLFDRERYIDLAKDPGAVRRTGYYNKENARFQLDRPGHSPYVYNRQTLGLRLDSREEIGLFRYDEPLKGKPIKSFTDYARQLFGALMNAQEKIHLHGDDWQRTIYIDTLDVGTTDFNLSDATKQALIEQGINGTENYFEWFDNPLEKPVNRVES

SEQ ID NO: 923 - DNA, 684 bp, Unknown
  Obtained from environmental sample
atgctgaaaccgcctccctacggacgcctgctgcgcgaactggccgatatcccggccatcgtgacggcaccgttccggggcgctgcgaaaatgggcaaactggcggatggcgagccggtactggtgctgcccggcttcctggccgacgacaacgccacctcggtgctgcgcaagaccttcgatgtcgcgggctttgcctgttcgggctgggaacgcggcttcaacctcggcattcgtggcgacctcgtggaccggctggtcgaccggctgcgggcggtgtcggaggcggccggtggtcagaaggtgatcgtggtcggctggagcctcggcggcctctatgcgcgcgagctgggccacaaggcgcccgaactgatccggatggtcgtcacgctcggcagtccgttcgcgggcgacctccacgccaaccatgcgtggaagatctacgaggcgatcaacagccacacggtcgacaacctgccgatcccggtcgatttccagattaagccgccggtgcgcaccatcgcggtgtggtcgccgctcgacggggtggtggcgccggagacctcggaaggctcgcccgagcagtcggacgagcggctagagctggcggtgacccacatgggctttgccgcatcgaagaccggggccgaggctgtggtccggctggtcgcggcgcggctctag

SEQ ID NO: 924 - protein, 227 aa, Unknown
  Obtained from environmental sample
MLKPPPYGRLLRELADIPAIVTAPFRGAAKMGKLADGEPVLVLPGFLADDNATSVLRKTFDVAGFACSGWERGFNLGIRGDLVDRLVDRLRAVSEAAGGQKVIVVGWSLGGLYARELGHKAPELIRMVVTLGSPFAGDLHANHAWKIYEAINSHTVDNLPIPVDFQIKPPVRTIAVWSPLDGVVAPETSEGSPEQSDERLELAVTHMGFAASKTGAEAVVRLVAARL

SEQ ID NO: 925 - DNA, 777 bp, Unknown
  Obtained from environmental sample
atgttcattgcgcaccgaagcggactgcaaccgaatggcgacacgccgacattgctctatggatacggcggtttcaatgctgccgttacaccgcggttttccatatcgcgtcttgcctggatggaaatgggtggcgtctttgcgctggccaacatccggggcggcggcgagtacggtgatgaatggcacaaggccggcaccaagctgaaaaagcagaacgtgttcgacgatttcatcgccgccgcggaatacctggtggccaatcgctacacgcgacctgagaaactcgcagtcatgggtggcagcaacggcggcttgttggttggcgccgtcgtcaatcaaagaccggacctgttcgcagcgggacttccggccgtcggcgtaatggacatgctccgattccacaaatttaccgccggtcgtttctggactgacgattacggctctgcggacaacccggatgagttcaaggcgctgttggcctactcgccctaccataacctcgaagacggaaccgagtaccccgccatcctggtgaccaccgccgacacggatgaccgagtggttcccggtcacagtttcaagtacgcagcgaggttgcaggccgcacaagccggcagcgcaccggtgatgattcgtatcgagacccgcgcgggccatggctccggcaagccgaccgaactgatcatcggtgaggttacggacgaatgggcgttcctggtggacaatctcgacatgcaattgccggagagttacggcgttagcgctgacccataa

SEQ ID NO: 926 - protein, 258 aa, Unknown
  Obtained from environmental sample
  DOMAIN (28)...(107): Prolyl oligopeptidase family
MFIAHRSGLQPNGDTPTLLYGYGGFNAAVTPRFSISRLAWMEMGGVFALANIRGGGEYGDEWHKAGTKLKKQNVFDDFIAAAEYLVANRYTRPEKLAVMGGSNGGLLVGAVVNQRPDLFAAGLPAVGVMDMLRFHKFTAGRFWTDDYGSADNPDEFKALLAYSPYHNLEDGTEYPAILVTTADTDDRVVPGHSFKYAARLQAAQAGSAPVMIRIETRAGHGSGKPTELIIGEVTDEWAFLVDNLDMQLPESYGVSADP

SEQ ID NO: 927 - DNA, 1047 bp, Unknown
  Obtained from environmental sample
atgagaaagaaacaagtgagtatcaggggaaatctgattcgggaaatgatgcgggatgtgatgggaacggctctcggcaagccgattcagtccggggagattagaaggcatccggttgagccggcctggatctgtccgccgggatttatctatgaactgatcgatatggaacatttcaagatggaatatctgcagcctcaggatgtttataccgggcgggtggtgcttcagctgcatggtggcggatatattggcccgatgaagaatatttaccggagctttgctgtgaaatattcaagattaagtatgtatggagatgttttgacgattgattaccgggtggcgccggaacatccatatccggcggcgctggaggatgcgattgctgcgtatcggtggcttttggatgaaaaaaactatcggccggagcaaatcgtggtagcaggagattccgccggtggcggcctggcactggcgttgtgtctgtatctccgggatcatcagattccgctgccggccggtatcatagccatgtcgccctggacggatctgacactaagtggggagtcttatacatctaattatgaccacgatccgctgtttggtaataccagagaaagtatgttgtataattcaacttatattggggacagcgatccgacggatccgtatatgtctccgttgtttggagagtattttggattcccgccggtgttattgcaggtgggggatattgaggtgcttctcagcgatacacttcgggtttctgaaaaattgcgggaggctggggtaaagcagcggctttcggtttatgaaggcatgtttcattcgtttcagatgggactggatctgattccggagagccgtgaagcctgggaagaagtggaacgatttatcgggattgtctgccagattgagcggaaagctgaagggaaaattgttcgccgggtgaaggggaaaacagagaataaagatgaaaatcacattggttacggttggaaaaataaaagaaaaattttaccgggaggcaatttcggaatacagtaa

SEQ ID NO: 928 - protein, 348 aa, Unknown
  Obtained from environmental sample
MRKKQVSIRGNLIREMMRDVMGTALGKPIQSGEIRRHPVEPAWICPPGFIYELIDMEHFKMEYLQPQDVYTGRVVLQLHGGGYIGPMKNIYRSFAVKYSRLSMYGDVLTIDYRVAPEHPYPAALEDAIAAYRWLLDEKNYRPEQIVVAGDSAGGGLALALCLYLRDHQIPLPAGIIAMSPWTDLTLSGESYTSNYDHDPLFGNTRESMLYNSTYIGDSDPTDPYMSPLFGEYFGFPPVLLQVGDIEVLLSDTLRVSEKLREAGVKQRLSVYEGMFHSFQMGLDLIPESREAWEEVERFIGIVCQIERKAEGKIVRRVKGKTENKDENHIGYGWKNKRKILPGGNFGIQ

SEQ ID NO: 929 - DNA, 819 bp, Bacteria
gtgtcccgctctgcggactcggcgcaacaggccgctgcacggtgcataattcttgccatggacccttccaccgtcggtgtcgccctgagccacggcttcacgggcgggctcggcgggatcgcgccgtgggcggatgcgctccgcggcgccgggttccgcgtggccacgcccctcctccccggccacgggacttcgatcgaggacctcgcccgcaggtcgtggcacgagtggtacgacgcctatgaggcggcctacgtcgagctcgccgaggaatgcacggccgtcgtcgctgcggggctgtcgatgggcggggccctggcgctgcgccttgccgcgcaccgccctgtggccgccgtcagcgtggtcaaccccggcctcgtgatcgacgatccgcgctcgcacctctccggcgtgctgcggcacgtgatgcggacggttccgggcatccgcaacgacatcaagctcgcgggccaggacgagggcgcctacgagtcggtgcccgtggccgccgcgcaccagctcaagctcctgttccgggacaccgtcgcgtccctgccgcgcgccaccgccccgctgcaggtcttccgctcgacggtcgacagggtcgtcacgagcgagcgcagcgtcggcgcgatcgccgcccgctacggcgggacggacatccgcatcgtccggctcgccaacagctaccatgtggccactctggaccacgacgccgagacgatcttccggggctcggtcgccttcatcaaggaggcggtcgacgccgcgccgtcggccgccgcctgccgccgcatcgacgctgggggtgcggcgtga

SEQ ID NO: 930 - protein, 272 aa, Bacteria
MSRSADSAQQAAARCIILAMDPSTVGVALSHGFTGGLGGIAPWADALRGAGFRVATPLLPGHGTSIEDLARRSWHEWYDAYEAAYVELAEECTAVVAAGLSMGGALALRLAAHRPVAAVSVVNPGLVIDDPRSHLSGVLRHVMRTVPGIRNDIKLAGQDEGAYESVPVAAAHQLKLLFRDTVASLPRATAPLQVFRSTVDRVVTSERSVGAIAARYGGTDIRIVRLANSYHVATLDHDAETIFRGSVAFIKEAVDAAPSAAACRRIDAGGAA

SEQ ID NO: 931 - DNA, 636 bp, Unknown
  Obtained from environmental sample
atgaaggctaaactttatattttttcaggtttaggtgctgataaacgcattttcgaaaaactcgatttaagtgcattcgattgtgtttttatcgattggattacacctgaaaagaatgaatcgctccaaaattatgcgctaagaatttctaaagatattcccgaaaacgcatcaattcttggtgtttccttcggaggaatgcttgccgtagaaattgcgcatcacaaaaaactgaaccacttgtatttgatttcaactgcaaaaaccaagtttgaacttccaattctttatcgcatagcgggtaaaattggtttggttaatttgcttccttcaaaacttctgaaaaaagcaaatttcatttcgtattggttttttgggatgaaaacaaaagaagaaaagcgcttattgaaagccattttgaatgataccaattcctgttttctcaaatgggcaatgcgagcaatttgtttgtggaataatgaaaaagtacctgagaattatgttcattttcatggttcagctgataagattttaccttatagaaaaattaaaggtgcaataaaaattgaaaacggtggacatttaatggtttattcacaagttaaacaaattaacataaagattgaaccaatttga

SEQ ID NO: 932 - protein, 211 aa, Unknown
  Obtained from environmental sample
MKAKLYIFSGLGADKRIFEKLDLSAFDCVFIDWITPEKNESLQNYALRISKDIPENASILGVSFGGMLAVEIAHHKKLNHLYLISTAKTKFELPILYRIAGKIGLVNLLPSKLLKKANFISYWFFGMKTKEEKRLLKAILNDTNSCFLKWAMRAICLWNNEKVPENYVHFHGSADKILPYRKIKGAIKIENGGHLMVYSQVKQINIKIEPI

SEQ ID NO: 933 - DNA, 894 bp, Unknown
  Obtained from environmental sample
atgacccccgcgcccgacggcacgccactggccaactatgtgtggccagccgcgcccaacgtgcccccgccgatcgccggcctgggcacccccagtatctacctgctgcacggacttagcgagcatgccgggcgctatgaccgcctggcgcgctggctgaccgcacgcggctggacggtgggcgcccatgaccaccgcggccatggccgctccggcgggcggcccgccaccctgaaccatgaggacgatctggtcgtcgatgcggtcgaccgcctgcgggcctggaccgcggcccatggacgcccgcccatcctgctgggccacagcctgggcgcgctggtcgcggtgcggatcgccctgcgccgcctggccgagatcgacggcctggtgctcagttcgccgccgttcgtggtgcacgtgccgccgtgggtgcggcgcaccctgacctggatgtcgctgcatgcgcccgacctgcgcgtgccccacggcctggcgcccgcccgcatttcccacgacccggccgtggtcaaggcctaccgcagcgatccgctggtgcggcgccaaatgacaggacgcctggcgcgcttcgtggacgaaggcggccgcgagtccctgcgtgaagccccgctgctggcctgccgcaccctgctgatggtggcgggcgacgattccatcgtcgctgccgaaggcagccgccagttcgcccagcgcgcacccgccgaactgctgacgctgcgctggtacgacaccgcctggcacgagattttcaatgaaaccgcccccatcgccgacccggtctacgcagacctggacgagtggctggcgcgcaccgctcaggcattgtccctgtccccagtattgactccctcggcacaggaggccggcaccccgtaa

SEQ ID NO: 934 - protein, 297 aa, Unknown
  Obtained from environmental sample
  DOMAIN (58)...(269): alpha/beta hydrolase fold
MTPAPDGTPLANYVWPAAPNVPPPIAGLGTPSIYLLHGLSEHAGRYDRLARWLTARGWTVGAHDHRGHGRSGGRPATLNHEDDLVVDAVDRLRAWTAAHGRPPILLGHSLGALVAVRIALRRLAEIDGLVLSSPPFVVHVPPWVRRTLTWMSLHAPDLRVPHGLAPARISHDPAVVKAYRSDPLVRRQMTGRLARFVDEGGRESLREAPLLACRTLLMVAGDDSIVAAEGSRQFAQRAPAELLTLRWYDTAWHEIFNETAPIADPVYADLDEWLARTAQALSLSPVLTPSAQEAGTP

SEQ ID NO: 935 - DNA, 867 bp, Unknown
  Obtained from environmental sample
atgacgacgacagcttttttcttttcgatgcttatgacaatgctcgtttcgggggttgtatccgcgcagcaaaagccgactatgggttacgcgccggttaacgggcttaagatgtattacgagatccacggcagcggcgagccggtggtattgcttcatggggcgttcatggcaatttcaggcgactggaatgattggataaacgaactttccaaaacgcggaaagtgatcgccatcgaaatgcagggccacgggcgtacggcggatatcaagcgcgatatgacctccgagaacctttcagacgatgtggccgggctgctcgactatctcaagatcccgaacgcggatatcgtcggctacagtttgggcggcggcgttgcgatgcagtgtgcgatccgccatccgcagaaggtgcgaaaggtcgtcagcatttcggctccgatccggcgtgacggctgggtcaaggaagccaacgacttttggccgaacttcacttgggagatgttcaaaggtacgcctgccgaagtcgaatggaaaaaactaaacccgaagccggacgggttcccggcttttttcaatcacctcaaggcgactgcgatgcgcccatacgattttggcgccgacaaattcaaagcgaccaaagctccgatgttcttcatccacggcgacgccgacggcgtccggctcgatcacatcgcggaaatgtaccgcctcaagggcggggatctgcacggcgacatgcggccgcgctcggaatcgagactggccatcttgcctgacacgacccacgttaccttgatgaatcgcatgacgacgatcatcccgatgatcaacgactttctcgatgcgaaacccctaaagcaatag

SEQ ID NO: 936 - protein, 288 aa, Unknown
  Obtained from environmental sample
  SIGNAL (1)...(22)
  DOMAIN (74)...(279): alpha/beta hydrolase fold
MTTTAFFFSMLMTMLVSGVVSAQQKPTMGYAPVNGLKMYYEIHGSGEPVVLLHGAFMAISGDWNDWINELSKTRKVIAIEMQGHGRTADIKRDMTSENLSDDVAGLLDYLKIPNADIVGYSLGGGVAMQCAIRHPQKVRKVVSISAPIRRDGWVKEANDFWPNFTWEMFKGTPAEVEWKKLNPKPDGFPAFFNHLKATAMRPYDFGADKFKATKAPMFFIHGDADGVRLDHIAEMYRLKGGDLHGDMRPRSESRLAILPDTTHVTLMNRMTTIIPMINDFLDAKPLKQ

SEQ ID NO: 937 - DNA, 1437 bp, Unknown
  Obtained from environmental sample
atgaagatcagtgatatcgatgtcgatgccatcatcgagaatgccaggcagcagctgaaggatgacccttctgtatctccatcgttacgctctacgtttgagatactcctgttaatcattccaatactcttaggtcgcgtcagcaccaacagtcggaacagtagtaagccaccatcacaagatcctaaccgtgaaaagaaagcacgtgctaagagtgatcgtaaacccggcggccaacaaggacgcataggcacaacactcgtgcctaccgatgatcccgatgagatcaaagtcgtcaccgtagatcgtcggactttacccagaggccatacgtttaaacccgctggctttgaaaagcgacaagtatttgatatcgatatcagtcgtctagtcacagagtatcgcgctgaaatactggtagatgatcagggtaatcgtatcgtcgctcctttccccgaagcggttaagtcatctgttcaatatggtccggcgatcaaggcgcatgcagtttatttatcactgtatcagttgttgccctatgaccgcgtgcgtgagtattttgaagaccaacttcgtatcccgttgagtgtcggttcgttggttaacttcaataaagaagcattcgacaaagctgcacccttcgaagcctgggtgaaacgccagttgattcaatctcccgtggttcatgccgacgaaaccggcatcaatatcggtggtaagcggcattggttgcactgtgcatcgaatgacacgctaacctggcttgaacctcacaagcaaagagggcatcaggctatggatgatatcgggatattaccgtactttgccggtacgctctgtcatgatcactggaaaccctattatcgctataccgattgtgaccactcgctgtgtaatgctcatcatatacgcgagcttcaacgtgttgttgaacaagacaagcatgtctggccggagcggatgcagacactactttgcacgatgaatgacgcggtgatcaatgccggttgtgcactaacaccggaacaagtagccggttggcgaaaagcctatcgggactgcttaaagacggccgagatagagtgtccaccacccgatgaagcacaacgtgatggaaaacggggccgaatcaaacgtacaaccgctcggaacttactcgaaagactgagggacttcgaggatgatctactgaggtttttagatcatcctcaggtgccctttaccaacaatcagggtgaacgggatatacggatggtcaaggtacagcaaaaaatatcagggtgcttccgctcagaagaaggcgctcagaccttctgtcgtgtgcgcagttatttatcgacggcgcgaaagcagaacatcagtgcatctgaagcaatgacgtccttgtttaatggtgagcctttgccctttgtgaacgaagcagaccatactaaataa

SEQ ID NO: 938 - protein, 478 aa, Unknown
  Obtained from environmental sample
MKISDIDVDAIIENARQQLKDDPSVSPSLRSTFEILLLIIPILLGRVSTNSRNSSKPPSQDPNREKKARAKSDRKPGGQQGRIGTTLVPTDDPDEIKVVTVDRRTLPRGHTFKPAGFEKRQVFDIDISRLVTEYRAEILVDDQGNRIVAPFPEAVKSSVQYGPAIKAHAVYLSLYQLLPYDRVREYFEDQLRIPLSVGSLVNFNKEAFDKAAPFEAWVKRQLIQSPVVHADETGINIGGKRHWLHCASNDTLTWLEPHKQRGHQAMDDIGILPYFAGTLCHDHWKPYYRYTDCDHSLCNAHHIRELQRVVEQDKHVWPERMQTLLCTMNDAVINAGCALTPEQVAGWRKAYRDCLKTAEIECPPPDEAQRDGKRGRIKRTTARNLLERLRDFEDDLLRFLDHPQVPFTNNQGERDIRMVKVQQKISGCFRSEEGAQTFCRVRSYLSTARKQNISASEAMTSLFNGEPLPFVNEADHTK

SEQ ID NO: 939 - DNA, 1017 bp, Unknown
  Obtained from environmental sample
atgaagttgatcttgattttgggattaagccttagcctgatggcgtgcggtgatgcaagctttcagcgggagaacgattccgatcgaagcccgactcctcaggaacaggaaaacgcggagtcgcctcgtgaggaggctgtgcctggttcatcggaccaaattcccgaaacgacttccactcagccgactgaaggaaaagaaaaagacaaagaagaagaaaaagcacttgaagctcttcagtacccaggtcgcacaggtccttacgctgttatcccgtacacggatactctcgcagatccgggctattcctcggccatcgtctattatccaagtgatcccaaagccaccatcatcggcgcgacgacgttaagcggtggtttcaccaacaccaaggagcagatgtcgtggcttggccagcatctggccagtcatggtatcgttgccctggttttcacgccgacgaataatcagtcgctcaatcccgcggtctgggccactggccataaggcgggttttcaaaagctgactgcggaagcccaacgtgtgggcagtcccattcaaggtcggatcgatgtgaagaaaattgggatcatgggtttttccatgggcggcgctggaacgatcctcgctgtgaacgagctcggcactgcggtcaaggccgcagttcccatctgcgctttccgcccggtcacacccacagccgccataccgtggatgctgctgacaggcaccaacgatacggtggctgttcctggaaacatcatcaatgcctatgaagccatgcagggaacaagtcccagagctttggccaattttcgtggcatgacgcatctggacgttcccaacggcggagcggcggctcagcacgaaaacctcgcgtattatgccacggcctggtacagggtttatttgggtggagacctgcgttatcaaacgtatctgtcgggtgatgagcagaagaagaagatcgatgcgggaacatttgcgaacgcgaatgactttcggttgatgccgtaa

SEQ ID NO: 940 - protein, 338 aa, Unknown
  Obtained from environmental sample
MKLILILGLSLSLMACGDASFQRENDSDRSPTPQEQENAESPREEAVPGSSDQIPETTSTQPTEGKEKDKEEEKALEALQYPGRTGPYAVIPYTDTLADPGYSSAIVYYPSDPKATIIGATTLSGGFTNTKEQMSWLGQHLASHGIVALVFTPTNNQSLNPAVWATGHKAGFQKLTAEAQRVGSPIQGRIDVKKIGIMGFSMGGAGTILAVNELGTAVKAAVPICAFRPVTPTAAIPWMLLTGTNDTVAVPGNIINAYEAMQGTSPRALANFRGMTHLDVPNGGAAAQHENLAYYATAWYRVYLGGDLRYQTYLSGDEQKKKIDAGTFANANDFRLMP

SEQ ID NO: 941 - DNA, 792 bp, Unknown
  Obtained from environmental sample
atgccatacctgcaacgaaaacagaccggaatctactgggagtcactgggccagggcgagcctgttgccttcctcaacggtatcctgatgacggtcgactcgtggaagcttcagaccgtcgagatcggccggcacttccgctgcgtcatgcacgactttcgcggccagttgcgaagttcaaaaccggacacgtcctggacactggaagaccacgcgaaggatttgaaagcgctgctggatcatctcggtatcgataactgtcacatcgttggcacgtcctacggcggcgaagtcggaatgatctttgccgccacctggcccgagcgggtccgcagcctgagtgtgatcgcttcggtgagtgaactggggccggacaccgaacgcatcgtgcgggactggcgccgggcggcattggaggcgccgatgtccctgtaccgcaccatgctgccaacgacgttttcaccggagttcgtggcggcgaaccccgggttgatcgaacagggtgaagaacggctgaaagccttcgataaagcattcttcgaggccttcgccagcctggttgacgcattctgcgcgctgaacatcacgcccatcctcgacaggatacgatgtccggcactggtcattgccggcgaaaatgatttgctcaaaccacctcgatacagccagatcatcgccgatggcatcgaaggatccgagcttctggtggcgcctggcgccggtcatgcggtcgtcctggaacaacccgcgttcataaaccggaagttgcttgactttatgggtcagcgctaa

SEQ ID NO: 942 - protein, 263 aa, Unknown
  Obtained from environmental sample
  DOMAIN (46)...(258): alpha/beta hydrolase fold
MPYLQRKQTGIYWESLGQGEPVAFLNGILMTVDSWKLQTVEIGRHFRCVMHDFRGQLRSSKPDTSWTLEDHAKDLKALLDHLGIDNCHIVGTSYGGEVGMIFAATWPERVRSLSVIASVSELGPDTERIVRDWRRAALEAPMSLYRTMLPTTFSPEFVAANPGLIEQGEERLKAFDKAFFEAFASLVDAFCALNITPILDRIRCPALVIAGENDLLKPPRYSQIIADGIEGSELLVAPGAGHAVVLEQPAFINRKLLDFMGQR

SEQ ID NO: 943 - DNA, 327 bp, Unknown
  Obtained from environmental sample
atgaggcatccgtcctttcgcccggcggcgatcgtcgccgccctgatcgtttggttggccgcgccgctctcagccggcggcgcgccggaggaggtgctcgcgcgcgtcgaggtggtcggactgctcgaggagctggggctgccggtccacgcccacctgatgggcggcgacggccgcgactacgcgctcgtcatcgcccggcccgaggcgctcgccgccgcgggttggccgtttaccgtcctgcaccggggggcggatccgaagccgagagccgaatggcggagcaaatcgcggcggctcgtgaatggcacagtgggatggaggtga

SEQ ID NO: 944 - protein, 108 aa, Unknown
  Obtained from environmental sample
MRHPSFRPAAIVAALIVWLAAPLSAGGAPEEVLARVEVVGLLEELGLPVHAHLMGGDGRDYALVIARPEALAAAGWPFTVLHRGADPKPRAEWRSKSRRLVNGTVGWR

SEQ ID NO: 945 - DNA, 759 bp, Unknown
  Obtained from environmental sample
atgggcaaacaaatgccttatagagtgatttttccagtaaactaccaaacttccaaaaaacgctatccagtgatttaccttctgcacggcctttcgggcaattacaaaaactggaccgagaaaaccaaattgacaaaatatgcaaccgaatacaacttcttgattatcacagttgaaggcgagaacggttggtattctgacagtaaaatcaaacctaacaggctttacgaaagctacataatccaggaactgatacctgaagttgataaaaagtttcgcacaatagcagatcgcaatcacagagctatcgcaggtctttcgatgggtggttacggtgcgataaagtttggcttgaaatatcctgaaaaattcgctttgattgggtcctttagcggcgctcttgcggcaacttcaatcaaggaaggcacagcgcttgagtggattacaaaaaccatcaatgatgctttcggtcctgaaggaagcgaatccagaaaagaaaacgatattttccagattgcgcgcgacctgaatgatgaacaaataaagaaacttccctttatttactttgattgcggaaccgaagattttctgttcaaagacaatcaggatttcatgaaactacttgttgaaaagagaatcaaacacgaatatagacaaaagcccggcacccatacgtgggaatactgggatagccaaataaaagaattcttgggtttagccaacaaatttatagaaaaaactgctttatggcgatactaa

SEQ ID NO: 946 - protein, 252 aa, Unknown
  Obtained from environmental sample
  DOMAIN (1)...(240): Putative esterase
MGKQMPYRVIFPVNYQTSKKRYPVIYLLHGLSGNYKNWTEKTKLTKYATEYNFLIITVEGENGWYSDSKIKPNRLYESYIIQELIPEVDKKFRTIADRNHRAIAGLSMGGYGAIKFGLKYPEKFALIGSFSGALAATSIKEGTALEWITKTINDAFGPEGSESRKENDIFQIARDLNDEQIKKLPFIYFDCGTEDFLFKDNQDFMKLLVEKRIKHEYRQKPGTHTWEYWDSQIKEFLGLANKFIEKTALWRY

SEQ ID NO: 947 - DNA, 2022 bp, Unknown
  Obtained from environmental sample
atgaacaacaacgaacaaccgacaaaacgccgcggcataacggtggaagatttgcttcgcctccgctcggtgcgcgacccgcactacgcgccggacgggacgcgcgccgtgtttgtggaaaaatcgattgatgaggaaaaacaataccgctcccatttatggatatgggcggcagacggctccgtccgtcaatggacgttcggccgctggcgcgacatgaagccgcgtttttccccaagaggtgaaatgatcgcctttttatctgaccgctccggacgcacacagctttggcttttgcccgccaatggcggtgaggcgcgccaactgacgtttttcaaaaacggtgtgcgcgattacgtttggtcgccggacgggacgtttctcatcgccctaacgacgcttggcgacgaagaaacgatcgaagaccgagaagagcagaaaacggcggaacaaaaaccggccgattcgaagccgcgcgttgtggaacggctctattacaaatcagacgcgtcgggttttcttgacggcaagcaggacgtgctggtgcgcatcgatgcggcgtcaggaaaaagcgaagcgttgacgggccgcgaggaagaaatcggttcgtttgccgtttccccaaccggacggacgctcgcctttgtcgccaaccgaaacgatgatccagacacaacctttacgcgcgacattgttttgcttgatctcgaatcgaaagcggaaacgaacttgacgaacggatgcggcacattcgcttcgctcgcctggtcgccggacggaacgaagctcgccgccatcggccatgatcttgcttatctcggggctacgcttcaccggctttacgtctttgagccggagcgtggaacgaagcgggtgttgaccgccgattgggacgtccatctcggcgatgccatggtcggcgacacacacgctgatgcgaaagggccgggaccgatttgggcgagcgacggaagcggcctgtatgtcaccgcctcggagcgcggacgcgtcaacttgtatttcgtcccgctcgacggcccgatcgttccggtgatcgaaggcaacttccatttatacggtttagccatccacccaagcgaacagcaagccatcgccgccatgagcgagccgacggtcattggcgatttgtatataatctcgcttgaagacggaacgaaaacacggcttacgcgtgccaatgaagcgctcgaaaacgaagtggtgttcgccgatgccgaaccgtttacgtatcgatcggcggatggttgggagattcaaggctggatcatgaaaccgcccgggcttggcgaaggggaaaaggcgccgcttgtcgtcgaaattcacggcgggccgcatgcgatgtacgggtttacctttttccatgaatttcaactgctcgtttcgcgtggttatgcggtcttgttcacgaacccgcgcggcagccacggatatggacaggcattcgtcaatgccgtgcgcggcgactatggcggcatggattatgaagacattatggccggcgtcgacgccgcgatcagcaagttcgacttcattgacgagacatggcttggcgtcactggcggcagctacggcgggtttatgaccaattggatcgtcgggcataccgaccggttcaaagcggctgtcacccagcgttccatttccaactggctcagtttctccggagtgagtgacatcggctactttttcacaaaatgggaggtcggctgcgacatctgggaagacgcggagcggctttggcatcattcaccgctcaaatacgtccaaaacatgcgcacaccgctcttaatcttgcatagcgagcgcgattaccgctgcccgatcgagcaggcggaacagctgtttatcgcattgaaacaactcgggcgggaaacgaaacttgtccgcttcccggacgccaaccacgatttgtcgcgcaccggcaacccggcgcttcgcctcgaacgtcttcgccaaatcgtcggttggtttgatcattatttgaaaggaccactggattaa

SEQ ID NO: 948 - protein, 673 aa, Unknown
  Obtained from environmental sample
MNNNEQPTKRRGITVEDLLRLRSVRDPHYAPDGTRAVFVEKSIDEEKQYRSHLWIWAADGSVRQWTFGRWRDMKPRFSPRGEMIAFLSDRSGRTQLWLLPANGGEARQLTFFKNGVRDYVWSPDGTFLIALTTLGDEETIEDREEQKTAEQKPADSKPRVVERLYYKSDASGFLDGKQDVLVRIDAASGKSEALTGREEEIGSFAVSPTGRTLAFVANRNDDPDTTFTRDIVLLDLESKAETNLTNGCGTFASLAWSPDGTKLAAIGHDLAYLGATLHRLYVFEPERGTKRVLTADWDVHLGDAMVGDTHADAKGPGPIWASDGSGLYVTASERGRVNLYFVPLDGPIVPVIEGNFHLYGLAIHPSEQQAIAAMSEPTVIGDLYIISLEDGTKTRLTRANEALENEVVFADAEPFTYRSADGWEIQGWIMKPPGLGEGEKAPLVVEIHGGPHAMYGFTFFHEFQLLVSRGYAVLFTNPRGSHGYGQAFVNAVRGDYGGMDYEDIMAGVDAAISKFDFIDETWLGVTGGSYGGFMTNWIVGHTDRFKAAVTQRSISNWLSFSGVSDIGYFFTKWEVGCDIWEDAERLWHHSPLKYVQNMRTPLLILHSERDYRCPIEQAEQLFIALKQLGRETKLVRFPDANHDLSRTGNPALRLERLRQIVGWFDHYLKGPLD

SEQ ID NO: 949 - DNA, 909 bp, Unknown
  Obtained from environmental sample
atggcaggtgctaagtcaaagattccgctcttgattgtttttatgatgagctggtacagttattctttttcccaggataggacagagactcatccggggagcgtggtatatgaatctgtggaattggagagtgaaattctggggaagattgttcgatacaatatttatctgcccaaagactatcataccagtacaatgaaatatccggtactttatctgctgcacgggtatagtgacgatgagacgggatggactcagttcggtcaggtcaaacgaatagcggatgacttgatcgatgcacatgaagccgcacagatggtaattgtgatgccggatgcgggagttacctggtatgtgaattgtgctgatgaagcagaaaaatacgaagatttctttattcgggaattgatgccgcatattgagcaggaatataaagtgcggaaaggaagacagttttccggtgtggctggattgtcgatgggcgggtatggagctttgatgttgagtcttcgacatccggatcttttttcttctgcgggtgttctgagtgcaggagtttttacggatgatgaaatcctcgatatggagcaggcgcaatgggatcgtttgctggggcttcctttcggaaaaggtttatctggtcaggatcgtctggcaggtaattatcagaagtattctcctgaaaagctgatcgctgcttataaagaaaagcaggggaatgttcggttttatatcgattgcggggacgatgattttttgatcctggggaatatgaacctgcatgcgatgatgattcaagagaaagtatcgcacgaattcagggtgcgggacggagggcatacctggggctattggcggagtggattgagatcagttctcccctttataagtgaagtattccaccggtag

SEQ ID NO: 950 - protein, 302 aa, Unknown
  Obtained from environmental sample
  SIGNAL (1)...(24)
  DOMAIN (32)...(296): Putative esterase
MAGAKSKIPLLIVFMMSWYSYSFSQDRTETHPGSVVYESVELESEILGKIVRYNIYLPKDYHTSTMKYPVLYLLHGYSDDETGWTQFGQVKRIADDLIDAHEAAQMVIVMPDAGVTWYVNCADEAEKYEDFFIRELMPHIEQEYKVRKGRQFSGVAGLSMGGYGALMLSLRHPDLFSSAGVLSAGVFTDDEILDMEQAQWDRLLGLPFGKGLSGQDRLAGNYQKYSPEKLIAAYKEKQGNVRFYIDCGDDDFLILGNMNLHAMMIQEKVSHEFRVRDGGHTWGYWRSGLRSVLPFISEVFHR

SEQ ID NO: 951 - DNA, 918 bp, Unknown
  Obtained from environmental sample
atgcatcactttatgccctcacttattctagcctgcggcgtgttcgcgacattcgcgtcacccgcggtggcgaccgaaacgaccgctgcggccgcgaatgtgaaaataacgaccgatcgagtttacggttcgatagccggcgtggagctgctgtgcgacatctacacccccgctgctggctatgcggttggcaaacgaccggtggtgttgctgattcacggcggggcttggtccgccggcagccgccggacgatggccgggcatgcgatgcggctggccagggcggggatcgtcggcatcgcgatcgattatcggctcgctccggcctggaagtttccggcccagttggacgatgttcgcgccgccatggtgtgggctgccgacaatgcagaggagctgggaatcgatccggcacggatggggctgtttggctatagcgccggcggacacctcgcctgtatgattgggacgctggtggatgagccagaaaatacgcaaatggcgaccaccgattggcagcgcgatgacccgcgattggcgcggttgccgcagccgttggcgatctgtgctggcggccccccctgcgacctcagcgaactcgcagtgggcagcaatgggctcgcgttttttctcggcggcagtcccacagagttgcctgaagtgtaccgggcggcctcaccggtttctcatgcctcggcgggcgatacgccgacgctgtatatccacggggaacgcgacgcgatcgtcccgctgcaaaacagcaaatcgctttaccgagcccagcggcaagccggtgtcccgagcgagttcttgatgatcccacagcaggggcacatcgtgacgtttgtcaatccgaaggctaaagatgcgatggtcgaattcttcgataaatggttcaatcaggaaagtccattatga

SEQ ID NO: 952 - protein, 305 aa, Unknown
  Obtained from environmental sample
  SIGNAL (1)...(24)
MHHFMPSLILACGVFATFASPAVATETTAAAANVKITTDRVYGSIAGVELLCDIYTPAAGYAVGKRPVVLLIHGGAWSAGSRRTMAGHAMRLARAGIVGIAIDYRLAPAWKFPAQLDDVRAAMVWAADNAEELGIDPARMGLFGYSAGGHLACMIGTLVDEPENTQMATTDWQRDDPRLARLPQPLAICAGGPPCDLSELAVGSNGLAFFLGGSPTELPEVYRAASPVSHASAGDTPTLYIHGERDAIVPLQNSKSLYRAQRQAGVPSEFLMIPQQGHIVTFVNPKAKDAMVEFFDKWFNQESPL

SEQ ID NO: 953 - DNA, 1629 bp, Unknown
  Environmental
atgagcctttgcgtcattcgattcatcgccggaactttggtacttgtggcgtcagtggaatcggcagttgctcaacaagcgtgtgctgacctgatgggcctcgagctgccgtatacaacgataacgtccgctgcagtggctaccgagggcccaatcccacagccggcgatctttggaagcactgaccccattgtggctccagagcgatgtgaagtgcgggcggtcacgcgccctacgaaggactccgagattcgaatcgagctctggctgccgctctccggatggaacggaaagtatctacaaattggtagcggtggctgggctggttcgatcaatcgaacggggctgataggccctcttcagcgcggttatgccgtagccgcaaccgacaatggccatatcagcgaaggtttggtgcctgacgcctcctgggctatcggccatccgcaaaagctgatcgatttcggttatcgcgccgtgcacgaaacaagtgttcaggccaaagctatcctgcgcgcctactttggccgcggtcaggatctgagctacttcagcggttgttctaatggcggacgcgaggctctcatggaggcgcagcgctatccggaagatttcgaaggcatcatcgccggagcgcccgcgaacaattggtcgcgcctgtttacggggtttgtgtggaatgaacgcgcgttggcggacgatccaattcctcctgccaagttgacagcgattcaggcggcggcaattgctgcgtgtgatacgctggacggtgttgaggacgggctcatcgaaaacccacgagcgtgtagcttcgatccgcgttcaatggtctgtacagccgatgatgcctctgactgtctgacagaaggacaggtcgcgacgctacacaggatatatagcggcccaaccaatcctcggaccggtgagcgaatctttccaggctatccgatgggcaccgaagccgtgccgggcggatgggtaccgtggatcgtgtccgcgagctccgaagttccgagcatacaagcaagctttggcaactcctattacgggcacgcggtcttcgagcaatcgaactgggatttcaggacgttggatttcgaccaggacgttgcgtttggcgatgcgaaggcggggccggtgctcaatgccacgaaccccgatctgcgttcgtttcgcgcgaatggcggcaaactgattcagtatcatggctggggcgatgcagccattacggcttttagttcgatcgactactacgagaacgtgcgcgccttcctcgatcgcttccccgacccccgaagcgagaacacggatatcgacggtttctatcgcctgttcctggttccgggcatgggacattgctccggcgggatcggcccaagtagctttggcaatggcttccgttccgcacgtacggatgccgagcacgacctactctccgcccttgaggcatgggtggagcgagacacggccccggagagattgatcggaacggggacggccgtaggcgacccaaccgcgactctgacgcgtccgctatgcccatatccgcggacggcacggtatctcggaagcggcaactcaaatgatgcggccaacttcgagtgcgccctgcccgctggcgtgcagtag

SEQ ID NO: 954 - protein, 542 aa, Unkown
  Environmental
  SIGNAL (1)...(24)
MSLCVIRFIAGTLVLVASVESAVAQQACADLMGLELPYTTITSAAVATEGPIPQPAIFGSTDPIVAPERCEVRAVTRPTKDSEIRIELWLPLSGWNGKYLQIGSGGWAGSINRTGLIGPLQRGYAVAATDNGHISEGLVPDASWAIGHPQKLIDFGYRAVHETSVQAKAILRAYFGRGQDLSYFSGCSNGGREALMEAQRYPEDFEGIIAGAPANNWSRLFTGFVWNERALADDPIPPAKLTAIQAAAIAACDTLDGVEDGLIENPRACSFDPRSMVCTADDASDCLTEGQVATLHRIYSGPTNPRTGERIFPGYPMGTEAVPGGWVPWIVSASSEVPSIQASFGNSYYGHAVFEQSNWDFRTLDFDQDVAFGDAKAGPVLNATNPDLRSFRANGGKLIQYHGWGDAAITAFSSIDYYENVRAFLDRFPDPRSENTDIDGFYRLFLVPGMGHCSGGIGPSSFGNGFRSARTDAEHDLLSALEAWVERDTAPERLIGTGTAVGDPTATLTRPLCPYPRTARYLGSGNSNDAANFECALPAGVQ

SEQ ID NO: 955 - DNA, 555 bp, Staphylothermus marinus F1
atgtctttaaacaagcactcttggatggatatgataatatttattctcagcttttctttcccattaacaatgatcgcattagctatctctatgtcgtcatggtttaatatatggaataatgcattaagcgatctaggacatgctgttaaaagcagtgttgctccaatattcaatctaggtcttgcaattggtgggatactaattgttatagttggtttaagaaatctttattcgtggagtagagttaaaggatctttaatcatatccatgggtgtatttcttaacttaataggggttttcgacgaagtatatggttggatacatttcctagtctcagtattgtttttcttatcaataatagcatatttcatagctatatcaatacttgacaaatcatggatagctgttctactaataataggtcatattgcaatgtggtatctacactttgcttcagagattccgagaggtgcggctattcccgagttattagcggtattctcgtttttaccattctatataagagactattttaaatcatacactaaacgatag

SEQ ID NO: 956 - protein, 184 aa, Staphylothermus marinus F1
  SIGNAL (1)...(28)
MSLNKHSWMDMIIFILSFSFPLTMIALAISMSSWFNIWNNALSDLGHAVKSSVAPIFNLGLAIGGILIVIVGLRNLYSWSRVKGSLIISMGVFLNLIGVFDEVYGWIHFLVSVLFFLSIIAYFIAISILDKSWIAVLLIIGHIAMWYLHFASEIPRGAAIPELLAVFSFLPFYIRDYFKSYTKR

SEQ ID NO: 957 - DNA, 1041 bp, Pyrodictium TAG11
atgaaactccttgagcccacaaatacctcctacacgctgttacaggatttagcattgcattttgcattttactggtttctggccgtgtatacgtggttacccggtgtcctagtccggggcgtagctgtggacacaggggtggctcgggtgcctgggctcggccggcgcggtaagaggctgctcctggccgctgtggctgtcttggcgcttgttgtgtccgttgttgtcccggcttatgtggcgtatagtagtctgcacccggagagctgtcggcccgttgcgccggaggggctcacctacaaagagttcagcgtgaccgcggaggatggcttggtggttcggggctgggtgctgggccccggcgctgggggcaacccggtgttcgttttgatgcacgggtatactgggtgccgctcggcgccctacatggctgtgctggcccgggagctcgtggagtgggggtacccggtggttgtgttcgacttccggggccacggggagagcgggggctcgacgacgattgggccccgggaggtgctggatgcccgggctgtggtgggctatgtctcggagcggttccccggccgccggataatattggtggggttcagtatgggcggcgctgtagcgatcgtggagggtgctggggacccgcgggtctacgcggtggctgctgatagcccgtactataggctccgggacgtcataccccggtggctggagtacaagacgccgctgccgggctgggtgggtgtgctggccgggttctacgggaggctgatggcgggcgttgacctcggcttcggccccgctggggtggagcgcgtggataagccgttgctggtggtgtatgggccccgggacccgctggtgacgcgggacgaggcgaggagcctggcgtcccgtagcccgtgtggccgtctcgtcgaggttcctggggctggccacgtggaggccgtggatgtgctcgggccgggccgctacgcagacatgctgatagagctggcgcacgaggagtgccctccgggggccggtggctga

SEQ ID NO: 958 - protein, 346 aa, Pyrodictium TAG11
MKLLEPTNTSYTLLQDLALHFAFYWFLAVYTWLPGVLVRGVAVDTGVARVPGLGRRGKRLLLAAVAVLALVVSVVVPAYVAYSSLHPESCRPVAPEGLTYKEFSVTAEDGLVVRGWVLGPGAGGNPVFVLMHGYTGCRSAPYMAVLARELVEWGYPVVVFDFRGHGESGGSTTIGPREVLDARAVVGYVSERFPGRRIILVGFSMGGAVAIVEGAGDPRVYAVAADSPYYRLRDVIPRWLEYKTPLPGWVGVLAGFYGRLMAGVDLGFGPAGVERVDKPLLVVYGPRDPLVTRDEARSLASRSPCGRLVEVPGAGHVEAVDVLGPGRYADMLIELAHEECPPGAGG

SEQ ID NO: 959 - DNA, 789 bp, Archaeoglobus venificus
atgccatatgttaggaatggtggtgtaaatatctattatgaactggtggatggacctgagccaccaattgtctttgttcacggatggacagcaaatatgaatttttggaaagagcaaagacgttattttgcaggcaggaatatgatgttgtttgtcgataacagaggtcatggcaggtccgataagccacttggatacgatttctacagatttgagaacttcatttcagatttagatgcggttgttagggagactggagtggagaaatttgttctcgtcggacattcattcggaacaatgatctctatgaagtactgttcggagtatcggaatcgggttcttgctctaatcctcataggtggtgggagcagaataaagcttctacacagaattggatatcctttagcaaagattcttgcatccattgcatacaagaagtcttcaagattggtcgcagatctttcctttggcaaaaatgctggtgaacttaaagagtggggatggaaacaggcaatggattatacaccctcctacgtggcaatgtacacgtacagaactctaacgaaagtgaatcttgaaaatatcttggagaaaatagactgtccaacactgattatcgttggagaagaggatgcactattgcccgttagcaaatcagttgagctgagcaggaggatagaaaactcaaagcttgtgatcatcccaaactcggggcattgcgtaatgcttgagagtccaagtgaggttaatagagcaatggacgaattcatttcttcagcacagttctaa

SEQ ID NO: 960 - protein, 262 aa, Archaeoglobus venificus
MPYVRNGGVNIYYELVDGPEPPIVFVHGWTANMNFWKEQRRYFAGRNMMLFVDNRGHGRSDKPLGYDFYRFENFISDLDAVVRETGVEKFVLVGHSFGTMISMKYCSEYRNRVLALILIGGGSRIKLLHRIGYPLAKILASIAYKKSSRLVADLSFGKNAGELKEWGWKQAMDYTPSYVAMYTYRTLTKVNLENILEKIDCPTLIIVGEEDALLPVSKSVELSRRIENSKLVIIPNSGHCVMLESPSEVNRAMDEFISSAQF

SEQ ID NO: 961 - DNA, 756 bp, Aquifex pyrophilus
ttgagattgaggaaatttgaagagataaacctcgttctttcgggaggagctgcaaagggcatagcccacataggtgttttgaaagctataaacgagctcggtataagggtgagggctttaagcggggtgagcgccggggcaatcgtttcggtcttttatgcctcaggctactcccctgaagggatgttcagccttctgaagagggtaaactggctgaagctgtttaagttcaagccacctctgaagggattgatagggtgggagaaggctataagattccttgaggaagttctcccttacaggagaatagaaaaacttgagataccgacgtatatatgcgcgacggatttatactcgggaagggctctatacctctcggaagggagtttaatccccgcacttctcggcagctgtgcaattcccggcatatttgaacccgttgagtataagaattacttgctcgttgacggaggtatagttaacaaccttcccgttgagccctttcaggaaagcggtattcccaccgtttgcgttgatgtccttcccatagagccggaaaaggatataaagaacattcttcacatccttttgaggagcttctttcttgcggtccgctcaaactccgaaaagagaaaggagttttgtgacctcgttatagttcctgagcttgaggagttcacaccccttgatgttagaaaagcggaccaaataatggagaggggatacataaaggccttagaggtactttctgaatag

SEQ ID NO: 962 - protein, 251 aa, Aquifex pyrophilus
MRLRKFEEINLVLSGGAAKGIAHIGVLKAINELGIRVRALSGVSAGAIVSVFYASGYSPEGMFSLLKRVNWLKLFKFKPPLKGLIGWEKAIRFLEEVLPYRRIEKLEIPTYICATDLYSGRALYLSEGSLIPALLGSCAIPGIFEPVEYKNYLLVDGGIVNNLPVEPFQESGIPTVCVDVLPIEPEKDIKNILHILLRSFFLAVRSNSEKRKEFCDLVIVPELEEFTPLDVRKADQIMERGYIKALEVLSE

SEQ ID NO: 963 - DNA, 789 bp, Thermococcus CL-2
atggaggtttacaaggccaaattcggcgaagcaaagctcggctgggtcgttctggttcatggcctcggcgagcacagcggaaggtatggaagactgattaaggaactcaactatgccggctttggagtttacaccttcgactggcccggccacgggaagagcccgggcaagagagggcacacgagcgtcgaggaggcgatggaaatcatcgactcgataatcgaggagatcagggagaagcccttcctcttcggccacagcctcggtggtctaactgtcatcaggtacgctgagacgcggcccgataaaatacggggattaatagcttcctcgcctgccctcgccaagagcccggaaacgccgggcttcatggtggccctcgcgaagttccttggaaagatcgccccgggagttgttctctccaacggcataaagccggaactcctctcgaggaacagggacgccgtgaggaggtacgttgaagacccactcgtccacgacaggatttcggccaagctgggaaggagcatcttcgtgaacatggagctggcccacagggaggcggacaagataaaagtcccgatcctccttctgatcggcactggcgatgtaataaccccgcctgaaggctcacgcagactcttcgaggagctggccgtcgagaacaaaaccctgagggagttcgagggggcgtaccacgagatatttgaagaccccgagtgggccgaggagttccacgaaacaattgttaagtggctggttgaaaaatcgtactcttcggctcaataa

SEQ ID NO: 964 - protein, 262 aa, Thermococcus CL-2
MEVYKAKFGEAKLGWVVLVHGLGEHSGRYGRLIKELNYAGFGVYTFDWPGHGKSPGKRGHTSVEEAMEIIDSIIEEIREKPFLFGHSLGGLTVIRYAETRPDKIRGLIASSPALAKSPETPGFMVALAKFLGKIAPGVVLSNGIKPELLSRNRDAVRRYVEDPLVHDRISAKLGRSIFVNMELAHREADKIKVPILLLIGTGDVITPPEGSRRLFEELAVENKTLREFEGAYHEIFEDPEWAEEFHETIVKWLVEKSYSSAQ

SEQ ID NO: 965 - DNA, 780 bp, Aquifex aeolicus VF-5
ttgattggcaatttgaaattgaagaggtttgaagaggttaacttagttctttcgggaggggctgccaagggtatcgcccatataggtgttttaaaagctctggaagagctcggtataaaggtaaagaggctcagcggggtaagtgctggagctatcgtttccgtcttttacgcttcgggctacactcccgacgagatgttaaaactcctgaaagaggtaaactggctcaaactttttaagttcaaaacaccgaaaatgggcttaatggggtgggagaaggctgcagagtttttggaaaaagagctcggagttaagaggctggaagacctgaacataccaacctatctttgctcggcggatctgtacacgggaaaggctctttacttcggcagaggtgacttaattcccgtgcttctcggaagttgttccatacccgggatttttgaaccagttgagtacgagaattttctacttgttgacggaggtatagtgaacaacctgcccgtagaacctttggaaaagttcaaagaacccataatcggggtagatgtgcttcccataactcaagaaagaaagattaaaaatatactccacatccttataaggagcttctttctggcggttcgttccaattcggaaaagagaaaggagttctgcaacgtagttatagaacctccccttgaagagttctctcctctggacgtaaataaggcggacgagatattcctgcggggatatgagagcactttaagaattatgagaaatttcgtaaaacattaa

SEQ ID NO: 966 - protein, 259 aa, Aquifex aeolicus VF-5
MIGNLKLKRFEEVNLVLSGGAAKGIAHIGVLKALEELGIKVKRLSGVSAGAIVSVFYASGYTPDEMLKLLKEVNWLKLFKFKTPKMGLMGWEKAAEFLEKELGVKRLEDLNIPTYLCSADLYTGKALYFGRGDLIPVLLGSCSIPGIFEPVEYENFLLVDGGIVNNLPVEPLEKFKEPIIGVDVLPITQERKIKNILHILIRSFFLAVRSNSEKRKEFCNVVIEPPLEEFSPLDVNKADEIFLRGYESTLRIMRNFVKH

SEQ ID NO: 967 - DNA, 927 bp, Archaeoglobus fulgidus VC16
atgccaatcgaccctgtttactaccagcttgctgagtatttcgacagtctgccgaagttcgaccagttttcctcggccagagagtacagggaggcgataaatcgaatatacgaggagagaaaccggcagctgagccagcatgagagggttgaaagagttgaggacaggacgattaaggggaggaacggagacatcagagtcagagtttaccagcagaagcccgattccccggttctggtttactatcacggtggtggatttgtgatttgcagcatcgagtcgcacgacgccttatgcaggagaattgcgagactttcaaactctaccgtagtctccgtggattacaggctcgctcctgagcacaagtttcccgccgcagtttatgattgctacgatgcgaccaagtgggttgctgagaacgccgaggagctgaggattgacccgtcaaaaatcttcgttgggggggacagtgcgggagggaatcttgccgcggcggtttcaataatggcgagagacagcggagaagatttcataaagcatcaaattctaatttaccccgttgtgaactttgtagcccccacaccatcgcttctggagtttggagaggggctgtggattctcgaccagaagataatgagttggttctcggagcagtacttctccagagaggaagataagttcaaccccctcgcctccgtaatctttgcggaccttgagaacctacctcctgcgctgatcataaccgccgaatacgacccgctgagagatgaaggagaagttttcgggcagatgctgagaagagccggtgttgaggcgagcatcgtcagatacagaggcgtgcttcacggattcatcaattactatcccgtgctgaaggctgcgagggatgcgataaaccagattgccgctcttcttgtgttcgactag

SEQ ID NO: 968 - protein, 308 aa, Archaeoglobus fulgidus VC16
MPIDPVYYQLAEYFDSLPKFDQFSSAREYREAINRIYEERNRQLSQHERVERVEDRTIKGRNGDIRVRVYQQKPDSPVLVYYHGGGFVICSIESHDALCRRIARLSNSTVVSVDYRLAPEHKFPAAVYDCYDATKWVAENAEELRIDPSKIFVGGDSAGGNLAAAVSIMARDSGEDFIKHQILIYPVVNFVAPTPSLLEFGEGLWILDQKIMSWFSEQYFSREEDKFNPLASVIFADLENLPPALIITAEYDPLRDEGEVFGQMLRRAGVEASIVRYRGVLHGFINYYPVLKAARDAINQIAALLVFD

SEQ ID NO: 969 - DNA, 918 bp, Sulfolobus solfataricus P1
atgcccctagatcctagaattaaaaagttactagaatcagctcttactataccaattggtaaagccccagtagaagaggtaagaaagatatttaggcaattagcgtcggcagctcccaaagtcgaagttggaaaagtagaagatataaaaataccaggcagtgaaaccgttataaacgctagagtgtattttccgaagagtagcggtccttatggtgttctagtgtatcttcatggaggcggttttgtaataggcgatgtggaatcttatgacccattatgtagagcaattacaaatgcgtgcaattgcgttgtagtatcagtggactataggttagctccagaatacaagtttccttctgcagttatcgattcatttgacgctactaattgggtttataacaatttagataaatttgatggaaagatgggagttgctattgcgggagatagtgctggaggaaatttggcagcggttgtagctcttctttcaaagggtaaaattaatttgaagtatcaaatactggtttacccagcggtaagtttagataacgtttcaagatccatgatagagtactctgatgggttcttccttaccagagagcatatagagtggttcggttctcaatacttacgaagccctgcagatttgctagactttaggttctctccaattctggcgcaagatttcaacggattacctccagccttgataataacagcagaatacgatccactaagggatcaaggagaagcgtatgcaaataaactactacaagctggagtctcagttactagtgtgagatttaacaacgttatacacggattcctctcattctttccgttgatggagcaaggaagagatgctataggtctgatagggtctgtgttaagacgagtattttatgataaaatttaa

SEQ ID NO: 970 - protein, 305 aa, Sulfolobus solfataricus P1
MPLDPRIKKLLESALTIPIGKAPVEEVRKIFRQLASAAPKVEVGKVEDIKIPGSETVINARVYFPKSSGPYGVLVYLHGGGFVIGDVESYDPLCRAITNACNCVVVSVDYRLAPEYKFPSAVIDSFDATNWVYNNLDKFDGKMGVAIAGDSAGGNLAAVVALLSKGKINLKYQILVYPAVSLDNVSRSMIEYSDGFFLTREHIEWFGSQYLRSPADLLDFRFSPILAQDFNGLPPALIITAEYDPLRDQGEAYANKLLQAGVSVTSVRFNNVIHGFLSFFPLMEQGRDAIGLIGSVLRRVFYDKI

SEQ ID NO: 971 - DNA, 906 bp, Metallosphaera prunae Ron
atgcccctacatccaaaggtaaagaaattactttcccagctacctccccaggacttctccagaaacgtgcaggacctgaggaaggcctgggatttacccttctcagggaggagggagaccctgaagagggttgaggaccttgagatacccactagggacgcacgaatcagggccagggtctacaccccctcaagtaaggaaaacttacccgtccttgtttactatcacggcggtggcttcgtgttcggtagcgttgacagctacgacggcctcgcatcccttattgccaaggaatctgggattgcggttatctccgtggagtataggctcgcccctgagcacaagttccccaccgcagtcaacgactcgtgggatgcgcttctctggatcgcggagaacggaggcaagctggggctcgacacctcgagacttgccgtggctggggatagtgctggaggaaacctgtctgccgtggtgtccctcctggacagggaccagggtaagggactggttagttatcaggtcctaatctacccagcagtgaacatggtcgataactccccatccgtcagggagtacggcgagggatacttcctcaccaggtccatgatgaactggttcgggaccatgtacttctcctctggaagggaagcggtatccccctacgcctctccagccttggctgacctacataacctcccaccctcactggtgatcactgcagagtatgatcccctaagggatcagggagagacctactctcactccctaaacgaggctggaaacgtatcaaccttggttagatatcaaggaatgattcacggcttcctgtccttctacgagtggataactgccggtaaactagccattcaccacattgctggggttctgagatctgtcctttag

SEQ ID NO: 972 - protein, 301 aa, Metallosphaera prunae Ron
MPLHPKVKKLLSQLPPQDFSRNVQDLRKAWDLPFSGRRETLKRVEDLEIPTRDARIRARVYTPSSKENLPVLVYYHGGGFVFGSVDSYDGLASLIAKESGIAVISVEYRLAPEHKFPTAVNDSWDALLWIAENGGKLGLDTSRLAVAGDSAGGNLSAVVSLLDRDQGKGLVSYQVLIYPAVNMVDNSPSVREYGEGYFLTRSMMNWFGTMYFSSGREAVSPYASPALADLHNLPPSLVITAEYDPLRDQGETYSHSLNEAGNVSTLVRYQGMIHGFLSFYEWITAGKLAIHHIAGVLRSVL

SEQ ID NO: 973 - DNA, 978 bp, Thermotoga neapolitana 5068
ttggccttcttcgatatgccccttgaggaactgaaaaattaccggcctgaaaggtacaaggagaaaaatttcgatgatttctggagggaaacacttaaagaaagcgaaggattccctctggatcccgtctttgaaaaggtggactttcatctcaaaacggttgaaacgtacgatgttactttctctggatacagggggcagagaataaagggctggcttcttgttccgaagttggcggaagaaaagcttccatgcgtcgtgcagtacataggttacaatggtggaaggggttttccacacgactggctgttctggccgtcaatgggttacatctgttttgtcatggacaccagggggcagggaagcggctggatgaagggagacacaccggattaccctgagggtccagtcgatccacagtaccccggattcatgacgaggggcattctggatccgggaacctattactacaggcgagtcttcgtggatgcggtcagggcggtggaagcagccatttccttcccgagagtggattccaggaaggtggtggtggccggaggcagtcagggtgggggaatcgcccttgcggtgagtgccctgtcgaacagggtgaaggctctgctctgcgatgtgccgtttctgtgccacttcagaagggccgtgcaacttgtcgacacacacccatacgtggagatcaccaacttcctcaaaacccacagggacaaagaggagattgttttcagaacactttcctacttcgatggtgtgaactttgcagcaagggcaaaggtgcccgccctgttttccgttgggctcatggacaccatctgtcctccctcgacggtcttcgccgcttacaaccactacgccggtccaaaggagatcagaatctatccgtacaacaaccacgaaggtggaggttctttccaggcaattgagcaggtgaaattcttgaagagactatttgaggaaggctag

SEQ ID NO: 974 - protein, 325 aa, Thermotoga neapolitana 5068
MAFFDMPLEELKNYRPERYKEKNFDDFWRETLKESEGFPLDPVFEKVDFHLKTVETYDVTFSGYRGQRIKGWLLVPKLAEEKLPCVVQYIGYNGGRGFPHDWLFWPSMGYICFVMDTRGQGSGWMKGDTPDYPEGPVDPQYPGFMTRGILDPGTYYYRRVFVDAVRAVEAAISFPRVDSRKVVVAGGSQGGGIALAVSALSNRVKALLCDVPFLCHFRRAVQLVDTHPYVEITNFLKTHRDKEEIVFRTLSYFDGVNFAARAKVPALFSVGLMDTICPPSTVFAAYNHYAGPKEIRIYPYNNHEGGGSFQAIEQVKFLKRLFEEG

SEQ ID NO: 975 - DNA, 1017 bp, Melittangium lichenicola
gtggccccgcgtggtgcaggccgtgaagaacctgcgctgagcagccggccaggcgggccctccccctcccgtcaggaggacggaccggagcgagggccccgtgtccaggcggcccgccggatgcgcaccctctccttcggtccgatgaccacagggggaagcattcacatggcgaccatggacgtgatgcgcgggccggggatgcagcggctgtcacagggcgccagggaggccgcgaaccacccctgggcgaagcgactgggccgcatgggctacgcggccaagggcgccgtgtacgccatcatcggcgtgctcgcgctgaagctcgcggcgggcgagggcggccggaccacggacagccacggcgcggtgaacaccgtggcgcacgggcccttcggcgtcgcgctgctggcggtgctggtggtgggcctgctgggctacgtggtctggaggttcgcccaggccttcgtggacacggaggacaagggctccgacgcgaagggaatcgccacgcgcgccatgtacttcctcagcggctgcatctacgcgtcgctggccctcttcgccgcgcagtccctggtgggcgccgcgcacggccggagcaaggggacgcagggctggacggccacgctgatggagcagccctttggccgcgtgctggtggcgctggtggggctgggcatcgtgggcttcgcgctgaagcagttccacaccgcgtggaaggcgaagttccgggagaagctcaccctcaccggactggctgcccggaagcagcaccacatcgagcgcatgtgccagttcggcatcgccgcgcgcggcgtggtgttcgccgtcatcggcggcttcctcgtccgctccgccgtggacgcgaaccccggcgaggccaagggcctgggagaggccctggccgtcgtcgcgaggcagccgtccggcgacgtgctcctgggggtggtggcggcgggcctggtggcctacgccgcctacctgttcctccaggcgcgctaccgcgaactctag

SEQ ID NO: 976 - protein, 338 aa, Melittangium lichenicola
MAPRGAGREEPALSSRPGGPSPSRQEDGPERGPRVQAARRMRTLSFGPMTTGGSIHMATMDVMRGPGMQRLSQGAREAANHPWAKRLGRMGYAAKGAVYAIIGVLALKLAAGEGGRTTDSHGAVNTVAHGPFGVALLAVLVVGLLGYVVWRFAQAFVDTEDKGSDAKGIATRAMYFLSGCIYASLALFAAQSLVGAAHGRSKGTQGWTATLMEQPFGRVLVALVGLGIVGFALKQFHTAWKAKFREKLTLTGLAARKQHHIERMCQFGIAARGVVFAVIGGFLVRSAVDANPGEAKGLGEALAVVARQPSGDVLLGVVAAGLVAYAAYLFLQARYREL

SEQ ID NO: 977 - DNA, 915 bp, Unknown
  Whale mat 11-801
  misc_feature (324)...(333): n = A,T,C or G
atgagcaaattcgcaatactctgggcgttgataacggcatacctgccggaacctgtgatgaaactggtatatttagggcggcgcgaaacgcttggggcacggacgcttgacgttaaagcccaagctgtcgggcggctggccaatgcaacaagacctgtcggggtgattccgacggtcgaggaaagccggaagatgacggataaagccgttagcctttttgatcagcccgcccccgaattattccgtaaaaaagacattcagattgacggggctgaagggcctattgatgcccgtatttacagcggccctgcaaaacatcgcccncgnccaatnctagtgtattttcacggcggtggctgggttcagggcaatctggacagccatgacggggtttgcggcaagctggcaaaatgggcgaactgcattgttatctcggtcgattatcgtctagcgcccgaacacaaatttccttgtgcgccgcttgatgcgattgcggcctataaatgggtgcgcgccaacgcaacaaaccttggcggcgatcctgaacgtatcggcgttggcggcgatagcgcagggggcaatcttgccgccgttgtctgccaacaaaccgccatgaacggcgagcgcacaccagatctgcaagtcctgatctatccggcgctggatgcacgcatgatctcgacctcgatggaggaattgcgtgatgcctacatcttgccgaaatccagaatggagtatttcctcggcctatatacgcgtggccctgacgatatcgaggaccttaggatgtcgccaattctcagggataccgtcgcggatcaaccccaagcctgcattgtcacctgtgggtttgaccctgcgcgacgacgggaacacctacgccgaacgcttaattgccgaggggatagacgttaa

SEQ ID NO: 978 - protein, 304 aa, Unknown
  Whale mat 11-801
  SIGNAL (1)...(21)
  VARIANT (111): Xaa = Any Amino Acid
MSKFAILWALITAYLPEPVMKLVYLGRRETLGARTLDVKAQAVGRLANATRPVGVIPTVEESRKMTDKAVSLFDQPAPELFRKKDIQIDGAEGPIDARIYSGPAKHRPRPXLVYFHGGGWVQGNLDSHDGVCGKLAKWANCIVISVDYRLAPEHKFPCAPLDAIAAYKWVRANATNLGGDPERIGVGGDSAGGNLAAVVCQQTAMNGERTPDLQVLIYPALDARMISTSMEELRDAYILPKSRMEYFLGLYTRGPDDIEDLRMSPILRDTVADQPQACIVTCGFDPARRREHLRRTLNCRGDRR

SEQ ID NO: 979 - DNA, 723 bp, Microscilla furvescens
gtgttacctatgcttacatttaatgttttatatggtatgatgaaacaaaaactagcagcaattctcatgtttttagggctatcagcagcagaggctcaagactggcctgacctacagaaatatcgtagtgctaataaagaagccaaattacttccaaaggaaaaccggaaggtggtttttatgggcaactccattacagaagcctggattagtcagcgacctgagttttttagtgaaaatgggtttatcggtcgaggcatcagtggccagacaacccctcagatgttgttgagattccgacaggatgtgatagacctgcagccaaaggctgtagtgatactagctggtaccaatgacgtagctcaaaataccgggccgatgaccattgaggaatcgcttgctaacattaagtctatggtggagctggcgcaagccaatgggatcacgcctgttttgtgtaccgtgctgcctgcagatcgtttcagctggcgacctgagcttacacccgcagaaactatcattgccctcaatcagctcattaagcaatatgccgaggcacagggcctggccctggtggattatcatgctgcactcaccaataaaggtggaggacttccggtgaaatacggagaagatggtgtgcatccaaatgtagcaggctatcaggtgatggaaaacattgttttaccggtcatttccagcgagttggcaaagctgaagtaa

SEQ ID NO: 980 - protein, 240 aa, Microscilla furvescens
  SIGNAL (1)...(32)
MLPMLTFNVLYGMMKQKLAAILMFLGLSAAEAQDWPDLQKYRSANKEAKLLPKENRKVVFMGNSITEAWISQRPEFFSENGFIGRGISGQTTPQMLLRFRQDVIDLQPKAVVILAGTNDVAQNTGPMTIEESLANIKSMVELAQANGITPVLCTVLPADRFSWRPELTPAETIIALNQLIKQYAEAQGLALVDYHAALTNKGGGLPVKYGEDGVHPNVAGYQVMENIVLPVISSELAKLK

SEQ ID NO: 981 - DNA, 978 bp, Thermotoga maritima MSB8
atggccttcttcgatttaccactcgaagaactgaagaaatatcgtccagagcggtacgaagagaaagacttcgatgagttctgggaagagacactcgcagagagcgaaaagttccccttagaccccgtcttcgagaggatggagtctcacctcaaaacagtcgaagcgtacgatgtcaccttctccggatacaggggacagaggatcaaagggtggctccttgttccaaaactggaagaagaaaaacttccctgcgttgtgcagtacataggatacaacggtggaagaggattccctcacgactggctgttctggccttctatgggttacatatgtttcgtcatggatactcgaggtcagggaagcggctggctgaaaggagacacaccggattaccctgagggtcccgttgaccctcagtatccaggattcatgacaagaggaatactggatcccagaacttactactacagacgagtcttcacggacgctgtcagagccgttgaagctgctgcttcttttcctcaggtagatcaagaaagaatcgtgatagctggaggcagtcagggtggcggaatagcccttgcggtgagcgctctctcaaagaaagcaaaggctcttctgtgcgatgtgccgtttctgtgtcacttcagaagagcagtacagcttgtggatacgcatccatacgcggagatcacgaactttctaaagacccacagagacaaggaagaaatcgtgttcaggactctttcctatttcgatggagtgaacttcgcagccagagcgaagatccctgcgctgttttctgtgggtctcatggacaacatttgtcctccttcaacggttttcgctgcctacaattactacgctggaccgaaggaaatcagaatctatccgtacaacaaccacgagggaggaggctctttccaagcggttgaacaggtgaaattcttgaaaaaactatttgagaaaggctaa

SEQ ID NO: 982 - protein, 325 aa, Thermotoga maritima MSB8
MAFFDLPLEELKKYRPERYEEKDFDEFWEETLAESEKFPLDPVFERMESHLKTVEAYDVTFSGYRGQRIKGWLLVPKLEEEKLPCVVQYIGYNGGRGFPHDWLFWPSMGYICFVMDTRGQGSGWLKGDTPDYPEGPVDPQYPGFMTRGILDPRTYYYRRVFTDAVRAVEAAASFPQVDQERIVIAGGSQGGGIALAVSALSKKAKALLCDVPFLCHFRRAVQLVDTHPYAEITNFLKTHRDKEEIVFRTLSYFDGVNFAARAKIPALFSVGLMDNICPPSTVFAAYNYYAGPKEIRIYPYNNHEGGGSFQAVEQVKFLKKLFEKG

SEQ ID NO: 983 - DNA, 1119 bp, Polyangium brachysporum
gtggtcgaacaccgacgagatcatccagccggtcacgaacgcgcagtgcggcagcagcacacggacgccggacgtgagccacaacgggctgctgtcgggacgagcgcgtctaccagcaggtgcgcgagcagctgcagtgatgcgcgcacgggcgagccgatgtgtcggcgttgcgcgcgcccgtgcccatctcatgctgctgctgctgcaacgcacaacaccttggccgaactcgccagcacaacggctgagcttgccaatgaccacaccggcgtgcaaacgcaaactggccccgctcgagagggaggcagggctgcgcggcccggcggtctcgagacacctctcgcgcatgacgagggcgcccgagggccggggcacctgcacctccatggcaaggacgaccgccacggcgcgtcgggcgcaaacaagggcatcagaccctgggtcgggattttcggatctcaatctcacgacaggagacaagacttgaagtacttcaaagcccggcttgccggcatcaccttgctcggcctgctggcctgcacctcggcctcggcgcagaccgagcccatcgtgttcgtgcacggctattccggcagcgcatccaactgggacaccatgctgggccgcttccggtcgaacggttatgcgtccggctcgctctacaccttcaactacaactcgttggtcagcagcaaccgcaccagcgccagcgagctgcgcagcttcgtcaacaccgtgcgttcgcgccacggcaacgcccgcatcgcgctggtcgcccactccaacggcgggctggtgtcgcgctggtatcgcgcggagctgggcggcgaaacggccacccgccgcttcgtgacgctgggcacgccgcaccggggcaccacctgggcctatgcgtgctacagccccgcatgtttcgagatgcgccccggctccagcttgctgaccacgctgggctcgcgtgcctgcgaccgctcgctgtggtcgaacaccgacggcatcatcctgccggcgtccagcgcgcagtgtggtgtcagcacgcgcactgccgacgtcagccatctcgacctgctgaccgactctcgcgtgtacacgcagttgcgcacgcagttgcaatga

SEQ ID NO: 984 - protein, 372 aa, Polyangium brachysporum
MVEHRRDHPAGHERAVRQQHTDAGREPQRAAVGTSASTSRCASSCSDARTGEPMCRRCARPCPSHAAAAATHNTLAELASTTAELANDHTGVQTQTGPAREGGRAARPGGLETPLAHDEGARGPGHLHLHGKDDRHGASGANKGIRPWVGIFGSQSHDRRQDLKYFKARLAGITLLGLLACTSASAQTEPIVFVHGYSGSASNWDTMLGRFRSNGYASGSLYTFNYNSLVSSNRTSASELRSFVNTVRSRHGNARIALVAHSNGGLVSRWYRAELGGETATRRFVTLGTPHRGTTWAYACYSPACFEMRPGSSLLTTLGSRACDRSLWSNTDGIILPASSAQCGVSTRTADVSHLDLLTDSRVYTQLRTQLQ

What is claimed is:

1. An isolated, synthetic, or recombinant polypeptide having a lipase activity comprising the amino acid as set forth in SEQ ID NO:924.

2. The polypeptide of claim 1, wherein the polypeptide lacks a signal sequence.

3. The polypeptide of claim 1, wherein the polypeptide further comprises a heterologous sequence or a heterologous signal sequence.

4. The polypeptide of claim 1, wherein the polypeptide is produced in a bacterial or yeast cell.

5. The polypeptide of claim 1, wherein the polypeptide is produced in a mammalian, insect, or plant cell.

6. The polypeptide of claim 1, wherein the polypeptide is immobilized.

7. The polypeptide of claim 6, wherein the polypeptide is immobilized on a cell, metal, resin, polymer, ceramic, glass, microelectrode, graphitic particle, bead, gel, plate, array, or capillary tube.

8. The polypeptide of claim 1, wherein the polypeptide is glycosylated.

9. A composition comprising the polypeptide of claim 1.

10. A protein preparation comprising the polypeptide of claim 1.

11. The protein preparation of claim 10, wherein the preparation is a food supplement.

12. The protein preparation of claim 10, wherein the preparation is a detergent.

13. A method for hydrolyzing a lipid, comprising:
    (a) providing the polypeptide of claim 1;
    (b) providing a composition comprising a lipid; and
    (c) contacting the polypeptide with the composition under conditions such that the polypeptide hydrolyzes the lipid.

14. The method of claim 13, wherein the lipid is linolenic acid, linoleic acid, oleic acid, palmitic acid, or stearic acid.

15. The method of claim 13, wherein the composition comprises an oil selected from vegetable oil, soybean oil, sunflower oil, cornoil, rapeseed oil, palm oil, or a lauric oil.

16. A method for oil or fat modification comprising:
    (a) providing a lipase of claim 1,
    (b) providing an oil or fat, and
    (c) contacting the lipase of (a) with the oil or fat of (b) under conditions wherein the lipase can modify the oil or fat,
    wherein optionally the modification comprises a lipase-catalyzed hydrolysis of the fat or oil, and optionally the hydrolysis is a complete or a partial hydrolysis of the fat or oil, and optionally the oil comprises a glycerol ester of a polyunsaturated fatty acid, or a fish, animal, or vegetable oil, and optionally the vegetable oil comprises an olive, canola, sunflower, palm, soy or lauric oil or rice bran oil,
    and optionally the lipase is immobilized.

17. A method for making a composition comprising 1-palmitoyl-3-stearoyl-2-monoleine (POSt) and 1,3-distearoyl-2-monoleine (StOSt) comprising
    (i) providing the lipase of claim 1, wherein the lipase is capable of 1,3-specific lipase-catalyzed interesterification of 1,3-dipalmitoyl-2-monoleine (POP) with stearic acid or tristearin, to make a product enriched in the 1-palmitoyl-3-stearoyl-2-monoleine (POSt) or 1,3-distearoyl-2-monoleine (StOSt),
    (ii) the method of (i), wherein the lipase is an Sn1, 3-specific lipase, or
    (iii) the method of (i), wherein the lipase is immobilized.

18. A method for treating an oil or fat comprising:
    (a) providing the lipase of claim 1,
    (b) providing an oil or fat, and
    (c) contacting the lipase of (a) with the oil or fat of (b) under conditions wherein the lipase can treat the oil or fat.

19. An oil or fat treated by the process of claim 18.

20. A composition comprising the oil or fat of claim 19.

* * * * *